(12) United States Patent
Chen et al.

(10) Patent No.: US 12,312,611 B2
(45) Date of Patent: May 27, 2025

(54) MODIFIED TERMINAL DEOXYNUCLEOTIDYL TRANSFERASE (TDT) ENZYMES

(71) Applicant: Nuclera Ltd, Cambridge (GB)

(72) Inventors: Michael Chun Hao Chen, Cambridge (GB); Gordon Ross McInroy, Cambridge (GB); Sihong Chen, Cambridge (GB); Ian Haston Cook, Cambridge (GB)

(73) Assignee: Nuclera, Ltd., Cambridge (GB)

( * ) Notice: Subject to any disclaimer, the term of this patent is extended or adjusted under 35 U.S.C. 154(b) by 730 days.

(21) Appl. No.: 17/428,003

(22) PCT Filed: Feb. 4, 2020

(86) PCT No.: PCT/GB2020/050247
§ 371 (c)(1),
(2) Date: Aug. 3, 2021

(87) PCT Pub. No.: WO2020/161480
PCT Pub. Date: Aug. 13, 2020

(65) Prior Publication Data
US 2022/0119781 A1    Apr. 21, 2022

(30) Foreign Application Priority Data
Feb. 4, 2019    (GB) .................................... 1901501

(51) Int. Cl.
*C12N 9/12*    (2006.01)

(52) U.S. Cl.
CPC .... *C12N 9/1264* (2013.01); *C12Y 207/07031* (2013.01)

(58) Field of Classification Search
CPC .................................................. C12N 9/1264
See application file for complete search history.

(56) References Cited

U.S. PATENT DOCUMENTS

| | | | |
|---|---|---|---|
| 2016/0108382 A1 | 4/2016 | Efcavitch et al. | |
| 2018/0023108 A1 | 1/2018 | Chen et al. | |

FOREIGN PATENT DOCUMENTS

| | | |
|---|---|---|
| WO | 2017/216472 A2 | 12/2017 |
| WO | 2018/215803 A1 | 11/2018 |

OTHER PUBLICATIONS

W5MK82_LEPOC. UniProtKB/TrEMBL Database. Nov. 22, 2017.*
Fransceus. J Ind Microbiol Biotechnol. May 2017;44(4-5):687-695.*

(Continued)

*Primary Examiner* — Yong D Pak
(74) *Attorney, Agent, or Firm* — McCarter & English, LLP; Yu Lu

(57) ABSTRACT

The invention relates to engineered terminal deoxynucleotidyl transferase (TdT) enzymes or the homologous amino acid sequence of Polµ, Polβ, Polλ, and Polθ of any species or the homologous amino acid sequence of X family polymerases of any species and their use in a method of nucleic acid synthesis, to methods of synthesizing nucleic acids, and to the use of kits comprising said enzymes in a method of nucleic acid synthesis. The invention also relates to the use of new terminal deoxynucleotidyl transferases and 3'-blocked nucleoside triphosphates in a method of template independent nucleic acid synthesis.

17 Claims, 15 Drawing Sheets

Specification includes a Sequence Listing.

(56) References Cited

OTHER PUBLICATIONS

Sanavia. Computational and Structural Biotechnology Journal, vol. 18, 2020, pp. 1968-1979.*
Studer. Residue mutations and their impact on protein structure and function: detecting beneficial and pathogenic changes. Biochem. J. (2013) 449, 581-594.*
V9KWD7_CALMI (UniProtKB/TrEMBL database. Nov. 22, 2017.*
Delarue et al., Crystal structures of a template-independent DNA polymerase: murine terminal deoxynucleotidyltransferase. EMBO J. Feb. 1, 2002;21(3):427-39.
International Search Report and Written Opinion for Application No. PCT/GB2020/050247, dated Jul. 13, 2020, 19 pages.

* cited by examiner

Figure 2

MODIFIED TERMINAL DEOXYNUCLEOTIDYL TRANSFERASE (TDT) ENZYMES

RELATED APPLICATIONS

This application is a 35 U.S.C. § 371 national stage filing of International Application No. PCT/GB2020/050247, filed Feb. 4, 2020, which claims the benefit of priority to United Kingdom Patent Application No. 1901501.5, filed Feb. 4, 2019.

REFERENCE TO SEQUENCE LISTING

This application includes an electronically submitted sequence listing in .txt format. The .txt file contains a sequence listing entitled "135815-00301_ST25.txt" created on Sep. 24, 2024 and is 2,592,961 bytes in size. The sequence listing contained in this .txt file is part of the specification and is hereby incorporated by reference herein in its entirety.

FIELD OF THE INVENTION

The invention relates to the use of specific terminal deoxynucleotidyl transferase (TdT) enzymes or the homologous amino acid sequence of Polµ, Polβ, Polλ, and Polθ of any species or the homologous amino acid sequence of X family polymerases of any species in a method of nucleic acid synthesis, to methods of synthesizing nucleic acids, and to the use of kits comprising said enzymes in a method of nucleic acid synthesis. The invention also relates to the use of terminal deoxynucleotidyl transferases or homologous enzymes and 3'-blocked nucleoside triphosphates in a method of template independent nucleic acid synthesis.

BACKGROUND OF THE INVENTION

Nucleic acid synthesis is vital to modern biotechnology. The rapid pace of development in the biotechnology arena has been made possible by the scientific community's ability to artificially synthesise DNA, RNA and proteins.

Artificial DNA synthesis allows biotechnology and pharmaceutical companies to develop a range of peptide therapeutics, such as insulin for the treatment of diabetes. It allows researchers to characterise cellular proteins to develop new small molecule therapies for the treatment of diseases our aging population faces today, such as heart disease and cancer. It even paves the way forward to creating life, as the Venter Institute demonstrated in 2010 when they placed an artificially synthesised genome into a bacterial cell.

However, current DNA synthesis technology does not meet the demands of the biotechnology industry. Despite being a mature technology, it is practically impossible to synthesise a DNA strand greater than 200 nucleotides in length, and most DNA synthesis companies only offer up to 120 nucleotides. In comparison, an average protein-coding gene is of the order of 2000-3000 contiguous nucleotides, a chromosome is at least a million contiguous nucleotides in length and an average eukaryotic genome numbers in the billions of nucleotides. In order to prepare nucleic acid strands thousands of base pairs in length, all major gene synthesis companies today rely on variations of a 'synthesise and stitch' technique, where overlapping 40-60-mer fragments are synthesised and stitched together by enzymatic copying and extension. Current methods generally allow up to 3 kb in length for routine production.

The reason DNA cannot be synthesised beyond 120-200 nucleotides at a time is due to the current methodology for generating DNA, which uses synthetic chemistry (i.e., phosphoramidite technology) to couple a nucleotide one at a time to make DNA. Even if the efficiency of each nucleotide-coupling step is 99% efficient, it is mathematically impossible to synthesise DNA longer than 200 nucleotides in acceptable yields. The Venter Institute illustrated this laborious process by spending 4 years and 20 million USD to synthesise the relatively small genome of a bacterium.

Known methods of DNA sequencing use template-dependent DNA polymerases to add 3'-reversibly terminated nucleotides to a growing double-stranded substrate. In the 'sequencing-by-synthesis' process, each added nucleotide contains a dye, allowing the user to identify the exact sequence of the template strand. Albeit on double-stranded DNA, this technology is able to produce strands of between 500-1000 bps long. However, this technology is not suitable for de novo nucleic acid synthesis because of the requirement for an existing nucleic acid strand to act as a template.

Various attempts have been made to use a terminal deoxynucleotidyl transferase for de novo single-stranded DNA synthesis. Uncontrolled de novo single-stranded DNA synthesis, as opposed to controlled, takes advantage of TdT's deoxynucleoside 5'-triphosphate (dNTP) 3'-tailing properties on single-stranded DNA to create, for example, homopolymeric adaptor sequences for next-generation sequencing library preparation. In controlled extensions, reversible deoxynucleoside 5'-triphosphate termination technology needs to be employed to prevent uncontrolled addition of dNTPs to the 3'-end of a growing DNA strand. The development of a controlled single-stranded DNA synthesis process through TdT would be invaluable to in situ DNA synthesis for gene assembly or hybridization microarrays as it removes the need for an anhydrous environment and allows the use of various polymers incompatible with organic solvents.

However, TdT has not been shown to efficiently add nucleoside triphosphates containing 3'-O-reversibly terminating moieties for building up a nascent single-stranded DNA chain necessary for a de novo synthesis cycle. A 3'-O— reversible terminating moiety would prevent a terminal transferase like TdT from catalysing the nucleotide transferase reaction between the 3'-end of a growing DNA strand and the 5'-triphosphate of an incoming nucleoside triphosphate.

There is therefore a need to identify modified terminal deoxynucleotidyl transferases that readily incorporate 3'-O— reversibly terminated nucleotides. Said modified terminal deoxynucleotidyl transferases can be used to incorporate 3'-O— reversibly terminated nucleotides in a fashion useful for biotechnology and single-stranded DNA synthesis processes in order to provide an improved method of nucleic acid synthesis that is able to overcome the problems associated with currently available methods.

BRIEF DESCRIPTION OF THE FIGURES

FIG. 2. (SEQ ID NOS: 730-740) Sequence alignment of selected orthologs of wild-type terminal deoxynucleotidyl transferases using the Clustal Omega multiple sequence alignment program provided by the European Molecular Biology Laboratory (EMBL) multiple sequence alignment site.

SUMMARY OF THE INVENTION

Figure 1:
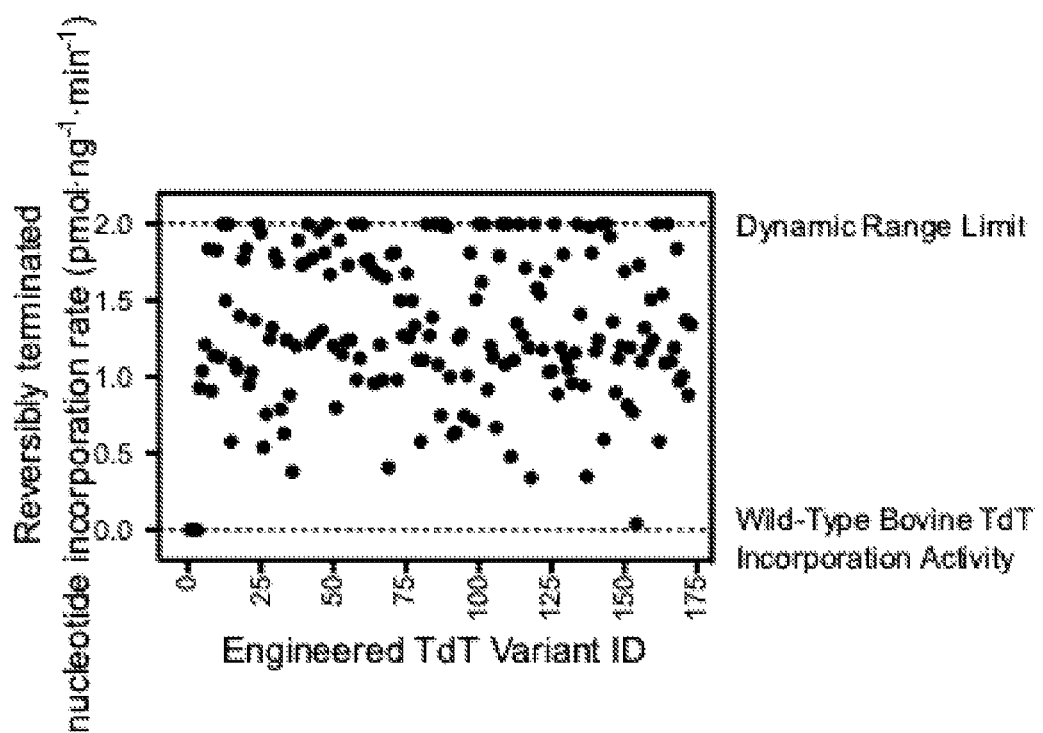
FIG. 1. Incorporation of 3'-O—CH$_2$—N$_3$ nucleoside 5'-triphosphates by terminal deoxynucleotidyl transferase (TdT) SEQ ID NOs 1-173. Incorporation rate is defined by quantity (pmol) of reversibly terminated nucleoside 5'-triphosphate incorporation to the 3'-end of a single-stranded DNA molecule per nanogram of TdT per minute. Wild-type bovine TdT activity is represented by the dotted line near y-axis=0. The dynamic range of the assay saturates at 2.0 pmol incorporate per nanogram of TdT per minute.

Described herein are modified terminal deoxynucleotidyl transferase (TdT) enzymes or the homologous amino acid sequence of Polμ, Polβ, Polλ, and Polθ of any species or the homologous amino acid sequence of X family polymerases of any species. Terminal transferase enzymes are ubiquitous in nature and are present in man yspecies. Many known TdT sequences have been reported in the NCBI database www.ncbi.nlm.nih.gov.

| GI Number | Species http://www.ncbi.nlm.nih.gov/ |
|---|---|
| gi\|768 | *Bos taurus* |
| gi\|460163 | *Gallus gallus* |
| gi\|494987 | *Xenopus laevis* |
| gi\|354475 | *Oncorhynchus mykiss* |
| gi\|2149634 | *Monodelphis domestica* |
| gi\|2802441 | *Mus musculus* |
| gi\|28852989 | *Ambystoma mexicanum* |
| gi\|38603668 | *Takifugu rubripes* |
| gi\|40037389 | *Raja eglanteria* |
| gi\|0218593 | *Ginglymostoma cirratum* |
| gi\|46369889 | *Danio rerio* |
| gi\|73998101 | *Canis lupus familiaris* |
| gi\|39001476 | *Lemur catta* |
| gi\|39001490 | *Microcebus murinus* |
| gi\|39001511 | *Otolemur garnettii* |
| gi\|48708614 | *Mus musculus* |
| gi\|49040157 | *Rattus norvegicus* |
| gi\|49704611 | *Equus caballus* |
| gi\|64451472 | *Bos taurus* |
| gi\|69642654 | *Xenopus (Silurana) tropicalis* |
| gi\|291394899 | *Oryctolagus cuniculus* |

-continued

| GI Number | Species http://www.ncbi.nlm.nih.gov/ |
|---|---|
| gi\|291404551 | *Oryctolagus cuniculus* |
| gi\|301763246 | *Ailuropoda melanoleuca* |
| gi\|311271684 | *Sus scrota* |
| gi\|327280070 | *Anolis carolinensis* |
| gi\|334313404 | *Monodelphis domestica* |
| gi\|344274915 | *Loxodonta africana* |
| gi\|345330196 | *Ornithorhynchus anatinus* |
| gi\|348588114 | *Cavia porcellus* |
| gi\|351697151 | *Heterocephalus glaber* |
| gi\|355562663 | *Macaca mulatta* |
| gi\|395501816 | *Sarcophilus harrisii* |
| gi\|395508711 | *Sarcophilus harrisii* |
| gi\|395850042 | *Otolemur garnettii* |
| gi\|397467153 | *Pan paniscus* |
| gi\|403278452 | *Saimiri boliviensis boliviensis* |
| gi\|410903980 | *Takifugu rubripes* |
| gi\|410975770 | *Felis catus* |
| gi\|432092624 | *Myotis davidii* |
| gi\|432113117 | *Myotis davidii* |
| gi\|444708211 | *Tupaia chinensis* |
| gi\|460417122 | *Pleurodeles waltl* |
| gi\|466001476 | *Orcinus orca* |
| gi\|471358897 | *Trichechus manatus latirostris* |
| gi\|478507321 | *Ceratotherium simum simum* |
| gi\|478528402 | *Ceratotherium simum simum* |
| gi\|488530524 | *Dasypus novemcinctus* |
| gi\|499037612 | *Maylandia zebra* |
| gi\|504135178 | *Ochotona princeps* |
| gi\|505844004 | *Sorex araneus* |
| gi\|505845913 | *Sorex araneus* |
| gi\|507537868 | *Jaculus jaculus* |
| gi\|507572662 | *Jaculus jaculus* |
| gi\|507622751 | *Octodon degus* |
| gi\|507640406 | *Echinops telfairi* |
| gi\|507669049 | *Echinops telfairi* |
| gi\|507930719 | *Condylura cristata* |
| gi\|507940587 | *Condylura cristata* |
| gi\|511850623 | *Mustela putorius furo* |
| gi\|512856623 | *Xenopus (Silurana) tropicalis* |
| gi\|512952456 | *Heterocephalus glaber* |
| gi\|524918754 | *Mesocricetus auratus* |
| gi\|527251632 | *Melopsittacus undulatus* |
| gi\|528493137 | *Danio rerio* |
| gi\|528493139 | *Danio rerio* |
| gi\|529438486 | *Falco peregrinus* |
| gi\|530565557 | *Chrysemys picta bellii* |
| gi\|532017142 | *Microtus ochrogaster* |
| gi\|532099471 | *Ictidomys tridecemlineatus* |
| gi\|533166077 | *Chinchilla lanigera* |
| gi\|533189443 | *Chinchilla lanigera* |
| gi\|537205041 | *Cricetulus griseus* |
| gi\|537263119 | *Cricetulus griseus* |
| gi\|543247043 | *Geospiza fortis* |
| gi\|543351492 | *Pseudopodoces humilis* |
| gi\|543731985 | *Columba livia* |
| gi\|544420257 | *Macaca fascicularis* |
| gi\|545193630 | *Equus caballus* |
| gi\|548384565 | *Pundamilia nyererei* |
| gi\|551487466 | *Xiphophorus maculatus* |
| gi\|551523268 | *Xiphophorus maculatus* |
| gi\|554582962 | *Myotis brandtii* |
| gi\|554588252 | *Myotis brandtii* |
| gi\|556778822 | *Pantholops hodgsonii* |
| gi\|556990133 | *Latimeria chalumnae* |
| gi\|557297894 | *Alligator sinensis* |
| gi\|558116760 | *Pelodiscus sinensis* |
| gi\|558207237 | *Myotis lucifugus* |
| gi\|560895997 | *Camelus ferus* |
| gi\|560897502 | *Camelus ferus* |
| gi\|562857949 | *Tupaia chinensis* |
| gi\|562876575 | *Tupaia chinensis* |
| gi\|564229057 | *Alligator mississippiensis* |
| gi\|564236372 | *Alligator mississippiensis* |
| gi\|564384286 | *Rattus norvegicus* |
| gi\|573884994 | *Lepisosteus oculatus* |

Figure 2:
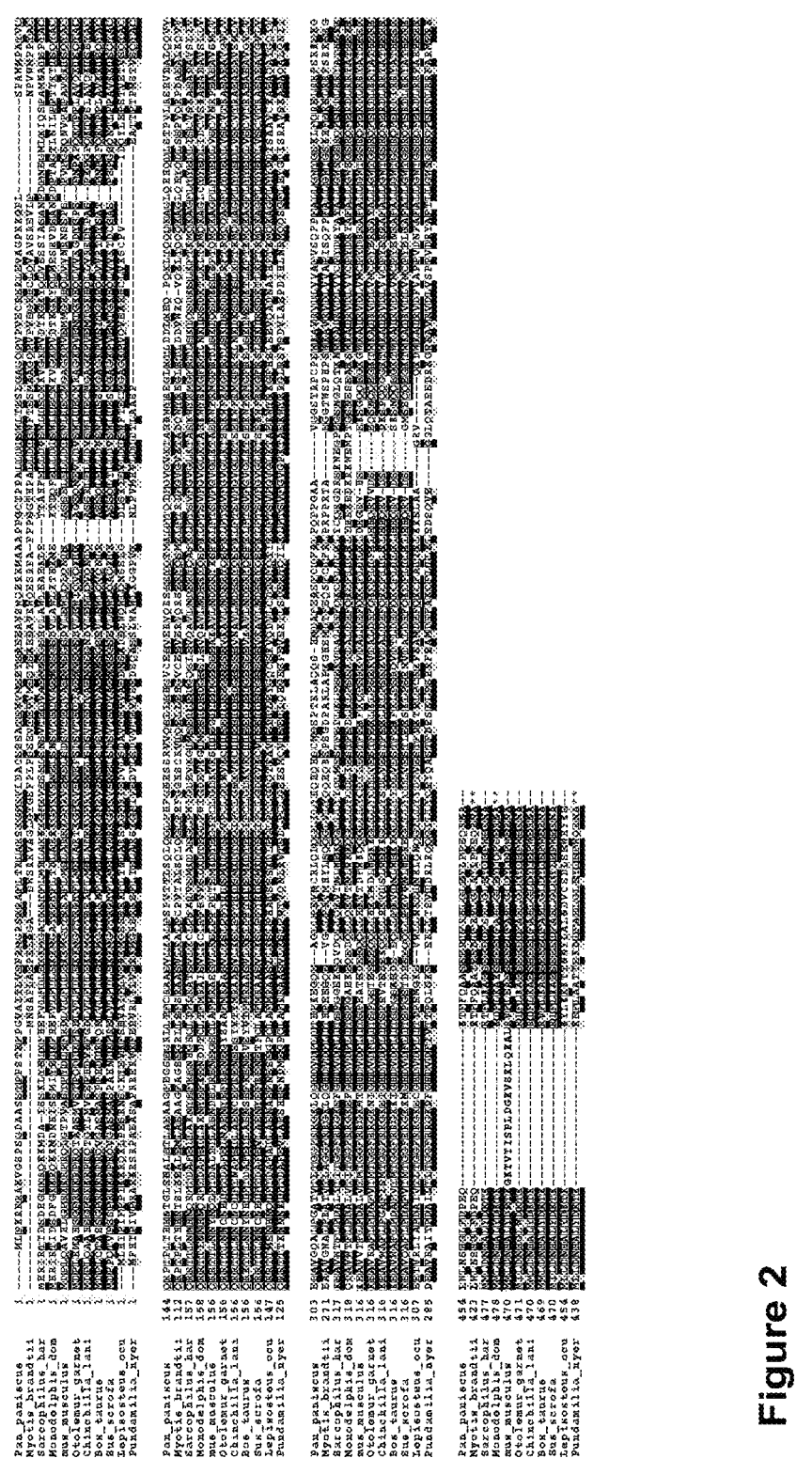

The sequences of the various described terminal transferases show some regions of highly conserved sequence, and some regions which are highly diverse between different species. A sequence alignment for sequences from a selection of species is shown in FIG. 2.

The inventors have modified the terminal transferase from *Lepisosteus oculatus* TdT (spotted gar) (shown as SED ID 1). However the corresponding modifications can be introduced into the analagous terminal transferase sequences from any other species, including the sequences listed above in the various NCBI entries, including those shown in FIG. 2 or truncated versions thereof.

The amino acid sequence of the spotted gar (*Lepisosteus oculatus*) is shown below (SEQ ID 1)

MLHIPIFPPIKKRQKLPESRNSCKYEVKFSEVAIFLVERKMGSSRRKFLT

NLARSKGFRIEDVLSDAVTHVVAEDNSADELWQWLQNSSLGDLSKIEVLD

ISWFTECMGAGKPVQVEARHCLVKSCPVIDQYLEPSTVETVSQYACQRRT

TMENHNQIFTDAFAILAENAEFNESEGPCLAFMRAASLLKSLPHAISSSK

DLEGLPCLGDQTKAVIEDILEYGQCSKVQDVLCDDRYQTIKLFTSVFGVG

LKTAEKWYRKGFHSLEEVQADNAIHFTKMQKAGFLYYDDISAAVCKAEAQ

AIGQIVEETVRLIAPDAIVTLIGGFRRGKECGHDVDFLITTPEMGKEVWL

LNRLINRLQNQGILLYYDIVESTFDKTRLPCRKFEAMDHFQKCFAIIKLK

KELAAGRVQKDWKAIRVDFVAPPVDNFAFALLGWTGSRQFERDLRRFARH

ERKMLLDNHALYDKTKKIFLPAKTEEDIFAHLGLDYIDPWQRNA

An engineered variant of this sequence was previously identified as SEQ ID NO 8 in publication WO2016/128731. Further engineered Improvements to this published sequence are described herein. The modified sequences disclosed herein are different to SEQ ID NO 8 disclosed in the prior art. WO2016/128731 SEQ ID NO 2 is a "mis-annotated" wild-type gar sequence.

SEQ ID NO 8 in publication WO2016/128731 is shown below with the engineered mutations identified:

MLHIPIFPPIKKRQKLPESRNSCKYEVKFSEVAIFLVERKMGSSRRKFLTNLARSKGFRIEDVLSDAV

THVVAE̊NNSADELL̊QWLQNSSLGDLSKIEVLDISWFTECMGACKPVQVEARHCLVKSCPVIDQYLEPS

TVETVSQYACQRRTTMENHNQIFTDAFAILAENAEFNESEGPCLAFMRAASLLKSLPHAISSSKDLEG

LPCLGDQTKAVIEDILEYGQCSKVQDVLCDDRYQTIKLFTSVFGVGLR̊TAEKWYRKGFHSLEEVQADN

AIHFTKMQKAGFLYYDDISAAVCKAEAQAIGQIVEETVRLIAPDAIVTLTGGFRRGKECGHDVDFLIT

TPEMGKEVWLLNRLINRLQNQGILLYYDIVESTFDKTRLPCRKFEAMDHFQKCFAIIKLKKELAAGRV

QKDWKAIRVDFVAPPVDNFAFALLGWIGSRQFERDLRRFARHERKMLLDNHALYDKTKKIFLPAKTEE

DIFAHLGLDYIDPWQRNA

The inventors have identified various amino acids modifications in the amino acid sequence having improved properties. Certain regions improve the solubility and handling of the enzyme. Certain other regions improve the ability to incorporate nucleotides with modifications; these modifications include modifications at the 3'-position of the sugar and modifications to the base.

Described herein are modified terminal deoxynucleotidyl transferase (TdT) enzymes comprising amino acid modifications when compared to a wild type sequence SEQ ID NO 1 or a truncated version thereof or the homologous amino acid sequence of a terminal deoxynucleotidyl transferase (TdT) enzyme in other species or the homologous amino acid sequence of Polμ, Polβ, Polλ, and Polθ of any species or the homologous amino acid sequence of X family polymerases of any species, wherein the amino acid is modified at one or more of the amino acids: V32, A33, I34, F35, A53, V68, V71, E97, I101, M108, G109, A110, Q115, V116, S125, T137, Q143, M152, E153, N154, H155, N156, Q157, I158, I165, N169, N173, S175, E176, G177, P178, C179, L180, A181, F182, M183, R184, A185, L188, H194, A195, I196, S197, S198, S199, K200, E203, G204, D210, Q211, T212, K213, A214, I216, E217, D218, L220, Y222, V228, D230, Q238, T239, L242, L251, K260, G261, F262, H263, S264, L265, E267, Q269, A270, D271, N272, A273, H275, F276, T277, K278, M279, Q280, K281, S291, A292, A293, V294, C295, K296, E298, A299, Q300, A301, Q304, I305, T309, V310, R311, L312, I313, A314, I318, V319, T320, G328, K329, E330, C331, L338, T341, P342, E343, M344, G345, K346, W349, L350, L351, N352, R353, L354, I355, N356, R357, L358, Q359, N360, Q361, G362, I363, L364, L365, Y366, Y367, D368, I369, V370, K376, T377, C381, K383, D388, H389, F390, Q391, K392, F394, I397, K398, K400, K401, E402, L403, A404, A405, G406, R407, D411, A421, P422, P423, V424, D425, N426, F427, A430, R438, F447, A448, R449, H450, E451, R452, K453, M454, L455, L456, D457, N458, H459, A460, L461, Y462, D463, K464, T465, K466, K467, T474, D477, D485, Y486, I487, D488, P489.

Modifications which improve the solubility include a modification within the amino acid region WLLNRLINRLQNQGILLYYDIV (SEQ ID NO: 766) shown highlighted in the sequence below.

(SEQ ID NO: 1)
MLHIPIFPPIKKRQKLPESRNSCKYEVKFSEVAIFLVERKMGSSRRKFLTNLARSKGFRIEDVLSDAV

THVVAEDNSADELWQWLQNSSLGDLSKIEVLDISWFTECMGAGKPVQVEARHCLVKSCPVIDQYLEPS

TVETVSQYACQRRTTMENHNQIFTDAFAILAENAEFNESEGPCLAFMRAASLLKSLPHAISSSKDLEG

LPCLGDQTKAVIEDILEYGQCSKVQDVLCDDRYQTIKLFTSVFGVGLKTAEKWYRKGFHSLEEVQADN

AIHFTKMQKAGFLYYDDISAAVCKAEAQAIGQIVEETVRLIAPDAIVTLTGGFRRGKECGHDVDFLIT

TPEMGKEVWLLNRLINRLQNQGILLYYDIVESTFDKTRLPCRKFEAMDHFQKCFAIIKLKKELAAGRV

QKDWKAIRVDFVAPPVDNFAFALLGWTGSRQFERDLRRFARHERKMLLDNHALYDKTKKIFLPAKTEE

DIFAHLGLDYIDPWQRNA

Modifications which improve the incorporation of modified nucleotides can be at one or more of selected regions shown below. Regions were selected according to mutation data (FIGS. 1 and 3), sequence alignment (FIG. 2), and structural data obtained from spotted gar TdT co-crystallized with DNA and a 3'-modified dNTP (FIGS. 4-14). The second modification can be selected from one or more of the amino acid regions VAIF (SEQ ID NO: 767), MGA, MENHNQI (SEQ ID NO: 763), SEGPCLAFMRA (SEQ ID NO: 743), HAISSS (SEQ ID NO: 768), DQTKA (SEQ ID NO: 769), KGFHS (SEQ ID NO: 770), QADNA (SEQ ID NO: 771), HFTKMQK (SEQ ID NO: 745), SAAVCK (SEQ ID NO: 747), EAQA (SEQ ID NO: 772), TVRLI (SEQ ID NO: 773), GKEC (SEQ ID NO: 749), TPEMGK (SEQ ID NO: 774), YYDIV (SEQ ID NO: 758), DHFQK (SEQ ID NO: 750), LAAG (SEQ ID NO: 775), APPVDNF (SEQ ID NO: 760), FARHERKMLLDNHALYDKTKK (SEQ ID NO: 754), and DYIDP (SEQ ID NO: 756) shown highlighted in the sequence below (SEQ ID NO: 1).

MLHIPIFPPIKKRQKLPESRNSCKYEVKFSEVAIFLVERKMGSSRRKFLTNLARSKGFRIEDVLSDAV

THVVAEDNSADELWQWLQNSSLGDLSKIEVLDISWFTECMGAGKPVQVEARHCLVKSCPVIDQYLEPS

TVETVSQYACQRRTTMENHNQIFTDAFAILAENAEFNESEGPCLAFMRAASLLKSLPHAISSSKDLEG

LPCLGDQTKAVIEDILEYGQCSKVQDVLCDDRYQTIKLFTSVFGVGLKTAEKWYRKGFHSLEEVQADN

AIHFTKMQKAGFLYYDDISAAVCKAEAQAIGQIVEETVRLIAPDAIVTLTGGFRRGKECGHDVDFLIT

TPEMGKEVWLLNRLINRLQNQGILLYYDIVESTFDKTRLPCRKFEAMDHFQKCFAIIKLKKELAAGRV

QKDWKAIRVDFVAPPVDNFAFALLGWTGSRQFERDLRRFARHERKMLLDNHALYDKTKKIFLPAKTEE

DIFAHLGLDYIDPWQRNA

Particular modifications which improve the incorporation of modified nucleotides can be at one or more of selected regions shown below. The second modification can be selected from one or more of the amino acid regions VAIF (SEQ ID NO: 767), MGA, ENHNQ (SEQ ID NO: 742), FMRA (SEQ ID NO: 744), HAI, TKA, FHS, QADNA (SEQ ID NO: 771), MQK, SAAVCK (SEQ ID NO: 747), EAQA (SEQ ID NO: 772), TVR, KEC, TPEMGK (SEQ ID NO: 774), DHFQ (SEQ ID NO: 751), LAAG (SEQ ID NO: 775), APPVDN (SEQ ID NO: 762), FARHERKMLLDNHA (SEQ ID NO: 753), and YIDP (SEQ ID NO: 757) shown highlighted in the sequence below (SEQ ID NO: 1).

MLHIPIFPPIKKRQKLPESRNSCKYEVKFSEVAIFLVERKMGSSRRKFLTNLARSKGFRIEDVLSDAV

THVVAEDNSADELWQWLQNSSLGDLSKIEVLDISWFTECMGAGKPVQVEARHCLVKSCPVIDQYLEPS

TVETVSQYACQRRTTMENHNQIFTDAFAILAENAEFNESEGPCLAFMRAASLLKSLPHAISSSKDLEG

LPCLGDQTKAVIEDILEYGQCSKVQDVLCDDRYQTIKLFTSVFGVGLKTAEKWYRKGFHSLEEVQADN

AIHFTKMQKAGFLYYDDISAAVCKAEAQAIGQIVEETVRLIAPDAIVTLTGGFRRGKECGHDVDFLIT

-continued

TPEMGKEVWLLNRLINRLQNQGILLYYDIVESTFDKTRLPCRKFEAMDHFQKCFAIIKLKKELAAGRV

QKDWKAIRVDFVAPPVDNFAFALLGWTGSRQFERDLRRFARHERKMLLDNHALYDKTKKIFLPAKTEE

DIFAHLGLDYIDPWQRNA

Described herein is a modified terminal deoxynucleotidyl transferase (TdT) enzyme comprising at least one amino acid modification when compared to a wild type sequence SEQ ID NO 1 or the homologous amino acid sequence of a terminal deoxynucleotidyl transferase (TdT) enzyme in other species, wherein the modification is selected from one or more of the amino acid regions WLLNRLINRLQNQGILLYYDIV (SEQ ID NO: 766), VAIF (SEQ ID NO: 767), MGA, MENHNQI (SEQ ID NO: 763), SEGPCLAFMRA (SEQ ID NO: 743), HAISSS (SEQ ID NO: 768), DQTKA (SEQ ID NO: 769), KGFHS (SEQ ID NO: 770), QADNA (SEQ ID NO: 771), HFTKMQK (SEQ ID NO: 745), SAAVCK (SEQ ID NO: 747), EAQA (SEQ ID NO: 772), TVRLI (SEQ ID NO: 773), GKEC (SEQ ID NO: 749), TPEMGK (SEQ ID NO: 774), DHFQK (SEQ ID NO: 750), LAAG (SEQ ID NO: 775), APPVDNF (SEQ ID NO: 760), FARHERKMLLDNHALYDKTKK (SEQ ID NO: 754), and DYIDP (SEQ ID NO: 756) of the sequence of SEQ ID NO 1 or the homologous regions in other species.

References to particular sequences include truncations thereof. Included herein are modified terminal deoxynucleotidyl transferase (TdT) enzyme comprising at least one amino acid modification when compared to a wild type sequence SEQ ID NO 1 or a truncated version thereof, or the homologous amino acid sequence of a terminal deoxynucleotidyl transferase (TdT) enzyme in other species, wherein the modification is selected from one or more of the amino acid regions WLLNRLINRLQNQGILLYYDIV (SEQ ID NO: 766), VAIF (SEQ ID NO: 767), MGA, MENHNQI (SEQ ID NO: 763), SEGPCLAFMRA (SEQ ID NO: 743), HAISSS (SEQ ID NO: 768), DQTKA (SEQ ID NO: 769), KGFHS (SEQ ID NO: 770), QADNA (SEQ ID NO: 771), HFTKMQK (SEQ ID NO: 745), SAAVCK (SEQ ID NO: 747), EAQA (SEQ ID NO: 772), TVRLI (SEQ ID NO: 773), GKEC (SEQ ID NO: 749), TPEMGK (SEQ ID NO: 774), DHFQK (SEQ ID NO: 750), LAAG (SEQ ID NO: 775), APPVDNF (SEQ ID NO: 760), FARHERKMLLDNHALYDKTKK (SEQ ID NO: 754), and DYIDP (SEQ ID NO: 756) of the sequence of SEQ ID NO 1 or the homologous regions in other species.

Truncated proteins may include at least the region shown below (SEQ ID NO: 776)

TVSQYACQRRTTMENHNQIFTDAFAILAENAEFNESEGPCLAFMRAASLL

KSLPHAISSSKDLEGLPCLGDQTKAVIEDILEYGQCSKVQDVLCDDRYQT

IKLFTSVFGVGLKTAEKWYRKGFHSLEEVQADNAIHFTKMQKAGFLYYDD

ISAAVCKAEAQAIGQIVEETVRLIAPDAIVTLTGGFRRGKECGHDVDFLI

TTPEMGKEVWLLNRLINRLQNQGILLYYDIVESTFDKTRLPCRKFEAMDH

FQKCFAIIKLKKELAAGRVQKDWKAIRVDFVAPPVDNFAFALLGWTGSRQ

FERDLRRFARHERKMLLDNHALYDKTKKIFLPAKTEEDIFAHLGLDYIDP

WQRNA

Described herein is a modified terminal deoxynucleotidyl transferase (TdT) enzyme comprising at least the sequence (SEQ ID NO: 776):

TVSQYACQRRTTMENHNQIFTDAFAILAENAEFNESEGPCLAFMRAASLL

KSLPHAISSSKDLEGLPCLGDQTKAVIEDILEYGQCSKVQDVLCDDRYQT

IKLFTSVEGVGLKTAEKWYRKGEHSLEEVQADNAIHFTKMQKAGFLYYDD

ISAAVCKAEAQAIGQIVEETVRLIAPDAIVTLTGGFRRGKECGHDVDFLI

TTPEMGKEVWLLNRLINRLQNQGILLYYDIVESTFDKTRLPCRKFEAMDH

FQKCFAIIKLKKELAAGRVQKDWKAIRVDEVAPPVDNFAFALLGWTGSRQ

FERDLRRFARHERKMLLDNHALYDKTKKIFLPAKTEEDIFAHLGLDYIDP

WQRNA or the homologous regions in other species, wherein the sequence has one or more amino acid modifications in one or more of the amino acid regions WLLNRLINRLQNQGILLYYDI (SEQ ID NO: 777), MENHNQI (SEQ ID NO: 763), SEGPCLAFMRA (SEQ ID NO: 743), HAISSS (SEQ ID NO: 768), DQTKA (SEQ ID NO: 769), KGFHS (SEQ ID NO: 770), QADNA (SEQ ID NO: 771), HFTKMQK (SEQ ID NO: 745), SAAVCK (SEQ ID NO: 747), EAQA (SEQ ID NO: 772), TVRLI (SEQ ID NO: 773), GKEC (SEQ ID NO: 749), TPEMGK (SEQ ID NO: 774), DHFQK (SEQ ID NO: 750), LAAG (SEQ ID NO: 775), APPVDNF (SEQ ID NO: 760), FARHERKMLLDNHALYDKTKK (SEQ ID NO: 754), and DYIDP (SEQ ID NO: 756) of the sequence.

(SEQ ID NO: 776)

TVSQYACQRRTTMENHNQIFTDAFAILAENAEFNESEGPCLAFMRAASLLKSLPHAISSSKDLEGLPC

LGDQTKAVIEDILEYGQCSKVQDVLCDDRYQTIKLFTSVFGVGLKTAEKWYRKGFHSLEEVQADNAIH

```
FTKMQKAGFLYYDDISAAVCKAEAQAIGQIVEETVRLIAPDAIVTLTGGFRRGKECGHDVDFLITTPE

MGKEVWLLNRLINRLQNQGILLYYDIVESTFDKTRLPCRKFEAMDHFQKCFAIIKLKKELAAGRVQKD

WKAIRVDFVAPPVDNFAFALLGWTGSRQFERDLRRFARHERKMLLDNHALYDKTKKIFLPAKTEEDIF

AHLGLDYIDPWQRNA
```

Disclosed herein is a modified terminal deoxynucleotidyl transferase (TdT) enzyme comprising at least one amino acid modification when compared to a wild type sequence, wherein the modification is selected from one or more of the amino acid regions WLLNRLINRLQNQGILLYYDI (SEQ ID NO: 777), VAIF (SEQ ID NO: 767), MGA, MENHNQI (SEQ ID NO: 763), SEGPCLAFMRA (SEQ ID NO: 743), HAISSS (SEQ ID NO: 768), DQTKA (SEQ ID NO: 769), KGFHS (SEQ ID NO: 770), QADNA (SEQ ID NO: 771), HFTKMQK (SEQ ID NO: 745), SAAVCK (SEQ ID NO: 747), EAQA (SEQ ID NO: 772), TVRLI (SEQ ID NO: 773), GKEC (SEQ ID NO: 749), TPEMGK (SEQ ID NO: 774), DHFQK (SEQ ID NO: 750), LAAG (SEQ ID NO: 775), APPVDNF (SEQ ID NO: 760), FARHERKMLLDNH-ALYDKTKK (SEQ ID NO: 754), and DYIDP (SEQ ID NO: 756) of the sequence of SEQ ID NO 1 or the homologous regions in other species.

Disclosed herein is a modified terminal deoxynucleotidyl transferase (TdT) enzyme comprising at least one amino acid modification when compared to a wild type sequence, wherein the modification is selected from one or more of the amino acid regions WLLNRLINRLQNQGILLYYDI (SEQ ID NO: 777), VAIF (SEQ ID NO: 767), MGA, ENHNQ (SEQ ID NO: 742), FMRA (SEQ ID NO: 744), HAI, TKA, FHS, QADNA (SEQ ID NO: 771), MQK, SAAVCK (SEQ ID NO: 747), EAQA (SEQ ID NO: 772), TVR, KEC, TPEMGK (SEQ ID NO: 774), DHFQ (SEQ ID NO: 751), LAAG (SEQ ID NO: 775), APPVDN (SEQ ID NO: 762), FARHERKMLLDNHA (SEQ ID NO: 753), and YIDP (SEQ ID NO: 757) of the sequence of SEQ ID NO 1 or the homologous regions in other species.

Described herein is a modified terminal deoxynucleotidyl transferase (TdT) enzyme comprising at least one amino acid modification when compared to a wild type sequence SEQ ID NO 1 or the homologous amino acid sequence of a terminal deoxynucleotidyl transferase (TdT) enzyme in other species, wherein the modification is selected from one or more of the amino acid regions WLLNRLINRLQNQGILLYYDI (SEQ ID NO: 777), VAIF (SEQ ID NO: 767), MGA, ENHNQ (SEQ ID NO: 742), FMRA (SEQ ID NO: 744), HAI, TKA, FHS, QADNA (SEQ ID NO: 771), MQK, SAAVCK (SEQ ID NO: 747), EAQA (SEQ ID NO: 772), TVR, KEC, TPEMGK (SEQ ID NO: 774), DHFQ (SEQ ID NO: 751), LAAG (SEQ ID NO: 775), APPVDN (SEQ ID NO: 762), FARHERKMLLDNHA (SEQ ID NO: 753), and YIDP (SEQ ID NO: 757) of the sequence of SEQ ID NO 1 or the homologous regions in other species.

Homologous refers to protein sequences between two or more proteins that possess a common evolutionary origin, including proteins from superfamilies in the same species of organism as well as homologous proteins from different species. Such proteins (and their encoding nucleic acids) have sequence homology, as reflected by their sequence similarity, whether in terms of percent identity or by the presence of specific residues or motifs and conserved positions. A variety of protein (and their encoding nucleic acid) sequence alignment tools may be used to determine sequence homology. For example, the Clustal Omega multiple sequence alignment program provided by the European Molecular Biology Laboratory (EMBL) can be used to determine sequence homology or homologous regions.

Improved sequences as described herein can contain both modifications, namely
a. a first modification is within the amino acid region WLLNRLINRLQNQGILLYYDIV (SEQ ID NO: 766) of the sequence of SEQ ID NO 1 or the homologous region in other species; and
b. a second modification is selected from one or more of the amino acid regions VAIF (SEQ ID NO: 767), MGA, MENHNQI (SEQ ID NO: 763), SEGPCLAFMRA (SEQ ID NO: 743), HAISSS (SEQ ID NO: 768), DQTKA (SEQ ID NO: 769), KGFHS (SEQ ID NO: 770), QADNA (SEQ ID NO: 771), HFTKMQK (SEQ ID NO: 745), SAAVCK (SEQ ID NO: 747), EAQA (SEQ ID NO: 772), TVRLI (SEQ ID NO: 773), GKEC (SEQ ID NO: 749), TPEMGK (SEQ ID NO: 774), DHFQK (SEQ ID NO: 750), LAAG (SEQ ID NO: 775), APPVDNF (SEQ ID NO: 760), FARHERKMLLDNHALYDKTKK (SEQ ID NO: 754), and DYIDP (SEQ ID NO: 756) of the sequence of SEQ ID NO 1 or the homologous regions in other species.

The sequence can be truncated Improved sequences as described herein can contain both modifications, namely
a. a first modification is within the amino acid region WLLNRLINRLQNQGILLYYDI (SEQ ID NO: 777) of the sequence of SEQ ID NO 1 or the homologous region in other species; and
b. a second modification is selected from one or more of the amino acid regions VAIF (SEQ ID NO: 767), MGA, ENHNQ (SEQ ID NO: 742), FMRA (SEQ ID NO: 744), HAI, TKA, FHS, QADNA (SEQ ID NO: 771), MQK, SAAVCK (SEQ ID NO: 747), EAQA (SEQ ID NO: 772), TVR, KEC, TPEMGK (SEQ ID NO: 774), DHFQ (SEQ ID NO: 751), LAAG (SEQ ID NO: 775), APPVDN (SEQ ID NO: 762), FARHERKMLLDNHA (SEQ ID NO: 753), and YIDP (SEQ ID NO: 757) of the sequence of SEQ ID NO 1 or the homologous regions in other species.

As a comparison with other species, the sequence of *Bos taurus* (cow) TdT is shown below (SEQ ID NO: 2):

```
MDPLCTASSGPRKKRPRQVGASMASPPHDIKFQNLVLFILEKKMGTTRRN

FLMELARRKGFRVENELSDSVTHIVAENNSGSEVLEWLQVQNIRASSQLE

LLDVSWLIESMGAGKPVEITGKHQLVVRTDYSATPNPGFQKTPPLAVKKI

SQYACQRKTTLNNYNHIFTDAFEILAENSEFKENEVSYVTFMRAASVLKS

LPFTIISMKDTEGIPCLGDKVKCIIEEIIEDGESSEVKAVLNDERYQSFK
```

LFTSVFGVGLKTSEKWFRMGFRSLSKIMSDKTLKFTKMQKAGFLYYEDLV

SCVTRAEAEAVGVLVKEAVWAFLPDAFVTMTGGFRRGKKIGHDVDFLITS

PGSAEDEEQLLPKVINLWEKKGLLLYYDLVESTFEKFKLPSRQVDTLDHF

QKCFLILKLHHQRVDSSKSNQQEGKTWKAIRVDLVMCPYENRAFALLGWT

GSRQFERDIRRYATHERKMMLDNHALYDKTKRVFLKAESEEEIFAHLGLD

YIEPWERNA

The homologous regions in the sequences are highlighted below.

Modifications which improve the solubility include a modification within the amino acid region QLLPKVINLWEKKGLLLYYDLV (SEQ ID NO: 778) shown highlighted in the sequence below (SEQ ID NO: 2).

MDPLCTASSGPRKKRPRQVGASMASPPHDIKFQNLVLFILEKKMGTTRRNFLMELARRKGFRVENELS

DSVTHIVAENNSGSEVLEWLQVQNIRASSQLELLDVSWLIESMGAGKPVEITGKHQLVVRTDYSATPN

PGFQKTPPLAVKKISQYACQRKTTLNNYNHIFTDAFEILAENSEFKENEVSYVTFMRAASVLKSLPFT

IISMKDTEGIPCLGDKVKCIIEEIIEDGESSEVKAVLNDERYQSFKLFTSVFGVGLKTSEKWFRMGFR

SLSKIMSDKTLKFTKMQKAGFLYYEDLVSCVTRAEAEAVGVLVKEAVWAFLPDAFVTMTGGFRRGKKI

GHDVDFLITSPGSAEDEEQLLPKVINLWEKKGLLLYYDLVESTFEKFKLPSRQVDTLDHFQKCFLILK

LHHQRVDSSKSNQQEGKTWKAIRVDLVMCPYENRAFALLGWTGSRQFERDIRRYATHERKMMLDNHAL

YDKTKRVFLKAESEEEIFAHLGLDYIEPWERNA

-

Modifications which improve the incorporation of modified nucleotides can be at one or more of selected regions shown below. The second modification can be selected from one or more of the amino acid regions LVLF (SEQ ID NO: 779), MGA, LNNYNHI (SEQ ID NO: 780), NEVSYVTFMRA (SEQ ID NO: 781), FTIISM (SEQ ID NO: 782), DKVKC (SEQ ID NO: 783), MGFRS (SEQ ID NO: 784), MSDKT (SEQ ID NO: 785), KFTKMQK (SEQ ID NO: 786), VSCVTR (SEQ ID NO: 787), EAEA (SEQ ID NO: 788), AVWAFL (SEQ ID NO: 789), GKKI (SEQ ID NO: 790), SPGSAE (SEQ ID NO: 791), YYDLV (SEQ ID NO: 792), DHFQK (SEQ ID NO: 750), MCPYENR (SEQ ID NO: 793), YATHERKMMLDNHALYDKTKR (SEQ ID NO: 794), and DYIEP (SEQ ID NO: 795) shown highlighted in the sequence below (SEQ ID NO: 2).

MDPLCTASSGPRKKRPRQVGASMASPPHDIKFQNLVLFILEKKMGTTRRNFLMELARRKGFRVENELS

DSVTHIVAENNSGSEVLEWLQVQNIRASSQLELLDVSWLIESMGAGKPVEITGKHQLVVRTDYSATPN

PGFQKTPPLAVKKISQYACQRKTTLNNYNHIFTDAFEILAENSEFKENEVSYVTFMRAASVLKSLPFT

IISMKDTEGIPCLGDKVKCIIEEIIEDGESSEVKAVLNDERYQSFKLFTSVFGVGLKTSEKWFRMGFR

SLSKIMSDKTLKFTKMQKAGFLYYEDLVSCVTRAEAEAVGVLVKEAVWAFLPDAFVTMTGGFRRGKKI

GHDVDFLITSPGSAEDEEQLLPKVINLWEKKGLLLYYDLVESTFEKFKLPSRQVDTLDHFQKCFLILK

LHHQRVDSSKSNQQEGKTWKAIRVDLVMCPYENRAFALLGWTGSRQFERDIRRYATHERKMMLDNHAL

YDKTKRVFLKAESEEEIFAHLGLDYIEPWERNA

Modifications which improve the incorporation of modified nucleotides can be at one or more of selected regions shown below. The second modification can be selected from one or more of the amino acid regions LVLF (SEQ ID NO: 779), MGA, NNYNH (SEQ ID NO: 796), FMRA (SEQ ID NO: 744), FTI, VKC, FRS, MSDKT (SEQ ID NO: 785), MQK, EAEA (SEQ ID NO: 788), AVW, KKI, SPGSAE (SEQ ID NO: 791), DHFQ (SEQ ID NO: 751), MCPYEN (SEQ ID NO: 797), YATHERKMMLDNHA (SEQ ID NO: 798), and YIEP (SEQ ID NO: 799) shown highlighted in the sequence below (SEQ ID NO: 2).

```
MDPLCTASSGPRKKRPRQVGASMASPPHDIKFQNLVLFILEKKMGTTRRNFLMELARRKGFRVENELS

DSVTHIVAENNSGSEVLEWLQVQNIRASSQLELLDVSWLIESMGAGKPVEITGKHQLVVRTDYSATPN

PGFQKTPPLAVKKISQYACQRKTTLNNYNHIFTDAFEILAENSEFKENEVSYVTFMRAASVLKSLPFT

IISMKDTEGIPCLGDKVKCIIEEIIEDGESSEVKAVLNDERYQSFKLFTSVFGVGLKTSEKWFRMGFR

SLSKIMSDKTLKFTKMQKAGFLYYEDLVSCVTRAEAEAVGVLVKEAVVAFLPDAFVTMTGGFRRGKKI

GHDVDFLITSPGSAEDEEQLLPKVINLWEKKGLLLYYDLVESTFEKFKLPSRQVDTLDHFQKCFLILK

LHHQRVDSSKSNQQEGKTWKAIRVDLVMCPYENRAFALLGWTGSRQFERDIRRYATHERKMMLDNHAL

YDKTKRVFLKAESEEEIFAHLGLDYIEPWERNA
```

As a comparison with other species, the sequence of *Mus musculus* (mouse) TdT is shown below (SEQ ID NO: 3):

```
MDPLQAVHLGPRKKRPRQLGTPVASTPYDIRFRDLVLFILEKKMGTTRRA

FLMELARRKGFRVENELSDSVTHIVAENNSGSDVLEWLQLQNIKASSELE

LLDISWLIECMGAGKPVEMMGRHQLVVNRNSSPSPVPGSQNVPAPAVKKI

SQYACQRRTTLNNYNQLFTDALDILAENDELRENEGSCLAFMRASSVLKS

LPFPITSMKDTEGIPCLGDKVKSIIEGIIEDGESSEAKAVLNDERYKSFK

LFTSVFGVGLKTAEKWFRMGFRTLSKIQSDKSLRFTQMQKAGFLYYEDLV

SCVNRPEAEAVSMLVKEAVVTFLPDALVTMTGGFRRGKMTGHDVDFLITS

PEATEDEEQQLLHKVTDFWKQQGLLLYCDILESTFEKFKQPSRKVDALDH

FQKCFLILKLDHGRVHSEKSGQQEGKGWKAIRVDLVMCPYDRRAFALLGW

TGSRQFERDLRRYATHERKMMLDNHALYDRTKGKTVTISPLDGKVSKLQK

ALRVFLEAESEEEIFAHLGLDYIEPWERNA
```

Modifications which improve the solubility include a modification within the amino acid region QLLHKVTDFWKQQGLLLYCDIL (SEQ ID NO: 800) shown highlighted in the sequence below (SEQ ID NO: 801).

```
MDPLQAVHLGPRKKRPRQLGTPVASTPYDIRFRDLVLFILEKKMGTTRRAFLMELARRKGFRVENELS

DSVTHIVAENNSGSDVLEWLQLQNIKASSELELLDISWLIECMGAGKPVEMMGKHQLVVNRNSSPSPV

PGSQNVPAPAVKKISQYACQRRTTLNNYNQLFTDALDILAENDELRENEGSCLAFMRASSVLKSLPFP

ITSMKDTEGIPCLGDKVKSIIEGIIEDGESSEAKAVLNDERYKSFKLFTSVFGVGLKTAEKWFRMGFR

TLSKIQSDKSLRFTQMQKAGFLYYEDLVSCVNRPEAEAVSMLVKEAVVTFLPDALVTMTGGFRRGKMT

GHDVDFLITSPEATEDEEQQLLHKVTDFWKQQGLLLYCDILESTFEKFKQPSRKVDALDHFQKCFLIL

KLDHGRVHSEKSGQQEGKGWKAIRVDLVMCPYDRRAFALLGWTGSRQFERDLRRYATHERKMMLDNHA

LYDRTKGKTVTISPLDGKVSKLQKALRVFLEAESEEEIFAHLGLDYIEPWERNA
```

Modifications which improve the incorporation of modified nucleotides can be at one or more of selected regions shown below. The second modification can be selected from one or more of the amino acid regions LVLF (SEQ ID NO: 779), MGA, LNNYNQL (SEQ ID NO: 802), NEGSCLAFMRA (SEQ ID NO: 803), FPITSM (SEQ ID NO: 804), DKVKS (SEQ ID NO: 805), MGFRT (SEQ ID NO: 806), QSDKS (SEQ ID NO: 807), RFTQMQK (SEQ ID NO: 808), VSCVNR (SEQ ID NO: 809), EAEA (SEQ ID NO: 788), AVVTFL (SEQ ID NO: 810), GKMT (SEQ ID NO: 811), SPEATE (SEQ ID NO: 812), DHFQK (SEQ ID NO: 750), SGQ, MCPYDRR (SEQ ID NO: 813), YATHERKMMLDNHALYDRT (SEQ ID NO: 814), R, and DYIEP (SEQ ID NO: 795) shown highlighted in the sequence below (SEQ ID NO: 801).

```
MDPLQAVHLGPRKKRPRQLGTPVASTPYDIRFRDLVLFILEKKMGTTRRAFLMELARRKGFRVENELS

DSVTHIVAENNSGSDVLEWLQLQNIKASSELELLDISWLIECMGAGKPVEMMGKHQLVVNRNSSPSPV
```

```
-continued
PGSQNVPAPAVKKISQYACQRRTTLNNYNQLFTDALDILAENDELRENEGSCLAFMRASSVLKSLPFP

ITSMKDTEGIPCLGDKVKSIIEGIIEDGESSEAKAVLNDERYKSFKLFTSVFGVGLKTAEKWFRMGFR

TLSKIQSDKSLRFTQMQKAGFLYYEDLVSCVNRPEAEAVSMLVKEAVVTFLPDALVTMTGGFRRGKMT

GHDVDFLITSPEATEDEEQQLLHKVTDFWKQQGLLLYCDILESTFEKFKQPSRKVDALDHFQKCFLIL

KLDHGRVHSEKSGQQEGKGWKAIRVDLVMCPYDRRAFALLGWTGSRQFERDLRRYATHERKMMLDNHA

LYDRTKGKTVTISPLDGKVSKLQKALRVFLEAESEEEIFAHLGLDYIEPWERNA
```

Modifications which improve the incorporation of modified nucleotides can be at one or more of selected regions shown below. The second modification can be selected from one or more of the amino acid regions LVLF (SEQ ID NO: 779), MGA, LNNYNQ (SEQ ID NO: 815), NEGSCLAFMRA (SEQ ID NO: 803), FPI, VKS, FRT, SKIQSDKS (SEQ ID NO: 816), MQK, VSCVNR (SEQ ID NO: 809), EAEA (SEQ ID NO: 788), AVV, KMT, SPEATE (SEQ ID NO: 812), DHFQK (SEQ ID NO: 750), MCPYDR (SEQ ID NO: 817), YATHERKMMLDNHA (SEQ ID NO: 798), and YIEP (SEQ ID NO: 799) shown highlighted in the sequence below (SEQ ID NO: 3).

```
MDPLQAVHLGPRKKRPRQLGTPVASTPYDIRFRDLVLFILEKKMGTTRRAFLMELARRKGFRVENELS

DSVTHIVAENNSGSDVLEWLQLQNIKASSELELLDISWLIECMGAGKPVEMMGRHQLVVNRNSSPSPV

PGSQNVPAPAVKKISQYACQRRTTLNNYNQLFTDALDILAENDELRENEGSCLAFMRASSVLKSLPFP

ITSMKDTEGIPCLGDKVKSIIEGIIEDGESSEAKAVLNDERYKSFKLFTSVFGVGLKTAEKWFRMGFR

TLSKIQSDKSLRFTQMQKAGFLYYEDLVSCVNRPEAEAVSMLVKEAVVTFLPDALVTMTGGFRRGKMT

GHDVDFLITSPEATEDEEQQLLHKVTDFWKQQGLLLYCDILESTFEKFKQPSRKVDALDHFQKCFLIL

KLDHGRVHSEKSGQQEGKGWKAIRVDLVMCPYDRRAFALLGWTGSRQFERDLRRYATHERKMMLDNHA

LYDRTKGKTVTISPLDGKVSKLQKALRVFLEAESEEEIFAHLGLDYIEPWERNA
```

Modifications which improve the incorporation of modified nucleotides can be at one or more of selected regions shown below. The second modification can be selected from one or more of the amino acid regions LVLF (SEQ ID NO: 779), MGA, NNYNQ (SEQ ID NO: 818), FMRA (SEQ ID NO: 744), FPI, VKS, FRT, QSDKS (SEQ ID NO: 807), MQK, VSCVNR (SEQ ID NO: 809), EAEA (SEQ ID NO: 788), AVV, KMT, SPEATE (SEQ ID NO: 812), DHFQ (SEQ ID NO: 751), MCPYDR (SEQ ID NO: 817), YATHERKMMLDNHA (SEQ ID NO: 798), and YIEP (SEQ ID NO: 799) shown highlighted in the sequence below (SEQ ID NO: 3).

```
MDPLQAVHLGPRKKRPRQLGTPVASTPYDIRFRDLVLFILEKKMGTTRRAFLMELARRKGFRVENELS

DSVTHIVAENNSGSDVLEWLQLQNIKASSELELLDISWLIECMGAGKPVEMMGRHQLVVNRNSSPSPV

PGSQNVPAPAVKKISQYACQRRTTLNNYNQLFTDALDILAENDELRENEGSCLAFMRASSVLKSLPFP

ITSMKDTEGIPCLGDKVKSIIEGIIEDGESSEAKAVLNDERYKSFKLFTSVFGVGLKTAEKWFRMGFR

TLSKIQSDKSLRFTQMQKAGFLYYEDLVSCVNRPEAEAVSMLVKEAVVTFLPDALVTMTGGFRRGKMT

GHDVDFLITSPEATEDEEQQLLHKVTDFWKQQGLLLYCDILESTFEKFKQPSRKVDALDHFQKCFLIL

KLDHGRVHSEKSGQQEGKGWKAIRVDLVMCPYDRRAFALLGWTGSRQFERDLRRYATHERKMMLDNHA

LYDRTKGKTVTISPLDGKVSKLQKALRVFLEAESEEEIFAHLGLDYIEPWERNA
```

Thus by a process of aligning sequences, it is immediately apparent which regions in the sequences of terminal transferases from other species correspond to the sequences described herein with respect to the spotted gar sequence shown in SEQ ID NO 1.

Sequence homology extends to all modified or wild-type members of family X polymerases, such as DNA Polµ (also known as DNA polymerase mu or POLM), DNA Polβ (also known as DNA polymerase beta or POLB), and DNA Polλ (also known known as DNA polymerase lambda or POLL). It is well known in the art that all family X member polymerases, of which TdT is a member, either have terminal transferase activity or can be engineered to gain terminal transferase activity akin to terminal deoxynucleotidyl transferase (Biochim Biophys Acta. 2010 May; 1804(5): 1136-1150). For example, when the following human TdT loop1 amino acid sequence (SEQ ID NO: 819)
. . . ESTFEKLRLPSRKVDALDHF . . .

was engineered to replace the following human Polµ amino acid residues (SEQ ID NO: 820)
. . . HSCCESPTRLAQQSHMDAF . . . , the chimeric human Polµ containing human TdT loop1 gained robust terminal transferase activity (Nucleic Acids Res. 2006 September; 34(16): 4572-4582).

Furthermore, it was generally demonstrated in US patent application no. 2019/0078065 that family X polymerases when engineered to contain TdT loop1 chimeras could gain robust terminal transferase activity. Additionally, it was demonstrated that TdT could be converted into a template-dependent polymerase through specific mutations in the loop1 motif (Nucleic Acids Research, June 2009, 37(14): 4642-4656). As it has been shown in the art, family X polymerases can be trivially modified to either display template-dependent or template-independent nucleotidyl transferase activities. Therefore, all motifs, regions, and mutations demonstrated in this patent can be trivially extended to modified X family polymerases to enable modified X family polymerases to incorporate 3'-modified nucleotides, reversibly terminated nucleotides, and modified nucleotides in general to effect methods of nucleic acid synthesis.

As a comparison with other family X polymerases, the human Polµ sequence is shown below (SEQ ID NO: 821):

MLPKRRRARVGSPSGDAASSTPPSTRFPGVAIYLVEPRMGRSRRAFLTGL

ARSKGFRVLDACSSEATHVVMEETSAEEAVSWQERRMAAAPPGCTPPALL

DISWLTESLGAGQPVPVECRHRLEVAGPRKGPLSPAWMPAYACQRPTPLT

HHNTGLSEALEILAEAAGFEGSEGRLLTFCRAASVLKALPSPVTTLSQLQ

GLPHFGEHSSRVVQELLEHGVCEEVERVRRSERYQTMKLFTQIFGVGVKT

ADRWYREGLRTLDDLREQPQKLTQQQKAGLQHHQDLSTPVLRSDVDALQQ

VVEEAVGQALPGATVTLTGGFRRGKLQGHDVDFLITHPKEGQEAGLLPRV

MCRLQDQGLILYHQHQHSCCESPTRLAQQSHMDAFERSFCIFRLPQPPGA

AVGGSTRPCPSWKAVRVDLVVAPVSQFPFALLGWTGSKLFQRELRRFSRK

EKGLWLNSHGLFDPEQKTFFQAASEEDIFRHLGLEYLPPEQRNA

Modifications which improve the solubility include a modification within the amino acid region GLLPRVM-CRLQDQGLILYHQHQ (SEQ ID NO: 822) shown highlighted in the sequence below (SEQ ID NO: 821).

MLPKRRRARVGSPSGDAASSTPPSTRFPGVAIYLVEPRMGRSRRAFLTGLARSKGFRVLDACSSEATH

VVMEETSAEEAVSWQERRMAAAPPGCTPPALLDISWLTESLGAGQPVPVECRHRLEVAGPRKGPLSPA

WMPAYACQRPTPLTHHNTGLSEALEILAEAAGFEGSEGRLLTFCRAASVLKALPSPVTTLSQLQGLPH

FGEHSSRVVQELLEHGVCEEVERVRRSERYQTMKLFTQIFGVGVKTADRWYREGLRTLDDLREQPQKL

TQQQKAGLQHHQDLSTPVLRSDVDALQQVVEEAVGQALPGATVTLTGGFRRGKLQGHDVDFLITHPKE

GQEAGLLPRVMCRLQDQGLILYHQHQHSCCESPTRLAQQSHMDAFERSFCIFRLPQPPGAAVGGSTRP

CPSWKAVRVDLVVAPVSQFPFALLGWTGSKLFQRELRRFSRKEKGLWLNSHGLFDPEQKTFFQAASEE

DIFRHLGLEYLPPEQRNA

Modifications which improve the incorporation of modified nucleotides can be at one or more of selected regions shown below. The second modification can be selected from one or more of the amino acid regions VAIY (SEQ ID NO: 821), LGA, LTHHNTG (SEQ ID NO: 824), SEG-RLLTFCRAA (SEQ ID NO: 825), SPVTTL (SEQ ID NO: 826), EHSSR (SEQ ID NO: 827), EGLRT (SEQ ID NO: 828), REQP (SEQ ID NO: 829), KLTQQQKA (SEQ ID NO: 830), STPVLR (SEQ ID NO: 831), DVDA (SEQ ID NO: 832), AVGQA (SEQ ID NO: 833), GKLQ (SEQ ID NO: 834), HPKEGQ (SEQ ID NO: 835), YHQHQ (SEQ ID NO: 836), DAFER (SEQ ID NO: 837), VAPVSQ (SEQ ID NO: 838), FSRKEKGLWLNSHGLFDPEQK (SEQ ID NO: 839), AND EYLPP (SEQ ID NO: 840) shown highlighted in the sequence below (SEQ ID NO: 821).

MLPKRRRARVGSPSGDAASSTPPSTRFPGVAIYLVEPRMGRSRRAFLTGLARSKGFRVLDACSSEATH

VVMEETSAEEAVSWQERRMAAAPPGCTPPALLDISWLTESLGAGQPVPVECRHRLEVAGPRKGPLSPA

-continued

```
WMPAYACQRPTPLTHHNTGLSEALEILAEAAGFEGSEGRLLTFCRAASVLKALPSPVTTLSQLQGLPH

FGEHSSRVVQELLEHGVCEEVERVRRSERYQTMKLFTQIFGVGVKTADRWYREGLRTLDDLREQPQKL

TQQQKAGLQHHQDLSTPVLRSDVDALQQVVEEAVGQALPGATVTLTGGFRRGKLQGHDVDFLITHPKE

GQEAGLLPRVMCRLQDQGLILYHQHQHSCCESPTRLAQQSHMDAPERSFCIFRLPQPPGAAVGGSTRP

CPSWKAVRVDLVVAPVSQFPFALLGWTGSKLFQRELRRFSRKEKGLWLNSHGLPDPEQKTFFQAASEE

DIFRHLGLEYLPPEQRNA
```

Thus by a process of aligning sequences, it is immediately apparent which regions in the sequences of all family X polymerases from any species correspond to the sequences described herein with respect to the spotted gar sequence shown in SEQ ID NO 1.

Furthermore, the A family polymerase, DNA Polθ (also known as DNA polymerase theta or POLQ) was demonstrated to display robust terminal transferase capability (eLife. 2016; 5: e13740). DNA Polθ was also demonstrated to be useful in methods of nucleic acid synthesis (GB patent application no. 2553274). In US patent application no. 2019/0078065, it was demonstrated that chimeras of DNA Polθ and family X polymerases could be engineered to gain robust terminal transferase activity and become competent for methods of nucleic acid synthesis. Therefore, all motifs, regions, and mutations demonstrated in this patent can be trivially extended to modified A family polymerases, especially DNA Polθ, to enable modified A family polymerases to incorporate 3'-modified nucleotides, reversibly terminated nucleotides, and modified nucleotides in general to effect methods of nucleic acid synthesis.

DETAILED DESCRIPTION OF THE INVENTION

Described herein are modified terminal deoxynucleotidyl transferase (TdT) enzymes. Terminal transferase enzymes are ubiquitous in nature and are present in many species. Many known TdT sequences have been reported in the NCBI database. The sequences described herein are modified from the sequence of the Spotted Gar, but the corresponding changes can be introduced into the homologous sequences from other species. Homologous amino acid sequences of Polμ, Polβ, Polλ, and Polθ or the homologous amino acid sequence of X family polymerases also possess terminal transferase activity. References to terminal transferase also include homologous amino acid sequences of Polμ, Polβ, Polλ, and Polθ or the homologous amino acid sequence of X family polymerases where such sequences possess terminal transferase activity.

Disclosed herein is a modified terminal deoxynucleotidyl transferase (TdT) enzyme comprising at least one amino acid modification when compared to a wild type sequence, wherein the modification is selected from one or more of the amino acid regions WLLNRLINRLQNQGILLYYDIV (SEQ ID NO: 766), VAIF (SEQ ID NO: 767), MGA, MENHNQI (SEQ ID NO: 763), SEGPCLAFMRA (SEQ ID NO: 743), HAISSS (SEQ ID NO: 768), DQTKA (SEQ ID NO: 769), KGFHS (SEQ ID NO: 770), QADNA (SEQ ID NO: 771), HFTKMQK (SEQ ID NO: 745), SAAVCK (SEQ ID NO: 747), EAQA (SEQ ID NO: 772), TVRLI (SEQ ID NO: 773), GKEC (SEQ ID NO: 749), TPEMGK (SEQ ID NO: 774), DHFQK (SEQ ID NO: 750), LAAG (SEQ ID NO: 775), APPVDNF (SEQ ID NO: 760), FARHERKMLL-DNHALYDKTKK (SEQ ID NO: 754), and DYIDP (SEQ ID NO: 756) of the sequence of SEQ ID NO 1 or the homologous regions in other species.

Described herein is a modified terminal deoxynucleotidyl transferase (TdT) enzyme comprising at least the sequence ID 729:

```
TVSQYACQRRTTMENHNQIFTDAFAILAENAEFNESEGPCLAFMRAASLL

KSLPHAISSSKDLEGLPCLGDQTKAVIEDILEYGQCSKVQDVLCDDRYQT

IKLFTSVFGVGLKTAEKWYRKGFHSLEEVQADNAIHFTKMQKAGFLYYDD

ISAAVCKAEAQAIGQIVEETVRLIAPDAIVTLTGGFRRGKECGHDVDFLI

TTPEMGKEVWLLNRLINRLQNQGILLYYDIVESTFDKTRLPCRKFEAMDH

FQKCFAIIKLKKELAAGRVQKDWKAIRVDEVAPPVDNFAFALLGWTGSRQ

FERDLRRFARHERKMLLDNHALYDKTKKIFLPAKTEEDIFAHLGLDYIDP

WQRNA
``` or the equivalent homologous region in other species, wherein the sequence has one or more amino acid modifications in one or more of the amino acid regions WLLNRLINRLQNQGILLYYDIV (SEQ ID NO: 766), MENHNQI (SEQ ID NO: 763), SEGPCLAFMRA (SEQ ID NO: 743), HAISSS (SEQ ID NO: 768), DQTKA (SEQ ID NO: 769), KGFHS (SEQ ID NO: 770), QADNA (SEQ ID NO: 771), HFTKMQK (SEQ ID NO: 745), SAAVCK (SEQ ID NO: 747), EAQA (SEQ ID NO: 772), TVRLI (SEQ ID NO: 773), GKEC (SEQ ID NO: 749), TPEMGK (SEQ ID NO: 774), DHFQK (SEQ ID NO: 750), LAAG (SEQ ID NO: 775), APPVDNF (SEQ ID NO: 760), FARHERKMLL-DNHALYDKTKK (SEQ ID NO: 754), and DYIDP (SEQ ID NO: 756) of the sequence. The sequence above of 355 amino acids can be attached to other amino acids without affecting the function of the enzyme. For example there can be a further N-terminal sequence that is incorporated simply as a protease cleavage site, for example the sequence MEN-LYFQG (SEQ ID NO: 765).

Disclosed is a modified terminal deoxynucleotidyl transferase (TdT) enzyme comprising at least one amino acid modification when compared to a wild type sequence SEQ ID NO 1 or the homologous amino acid sequence of a terminal deoxynucleotidyl transferase (TdT) enzyme in other species, wherein the modification is selected from one or more of the amino acid regions WLLNRLINRLQNQGILLYYDI (SEQ ID NO: 777), VAIF (SEQ ID NO: 767), MGA, ENHNQ (SEQ ID NO: 742), FMRA (SEQ ID NO: 744), HAI, TKA, FHS, QADNA (SEQ ID NO: 771), MQK, SAAVCK (SEQ ID NO: 747), EAQA (SEQ ID NO: 772), TVR, KEC, TPEMGK (SEQ ID NO:

774), DHFQ (SEQ ID NO: 751), LAAG (SEQ ID NO: 775), APPVDN (SEQ ID NO: 762), FARHERKMLLDNHA (SEQ ID NO: 753), and YIDP (SEQ ID NO: 757) of the sequence of SEQ ID NO 1 or the homologous regions in other species.

Further disclosed is a modified terminal deoxynucleotidyl transferase (TdT) enzyme comprising at least two amino acid modifications when compared to a wild type sequence SEQ ID NO 1 or the homologous amino acid sequence of a terminal deoxynucleotidyl transferase (TdT) enzyme in other species, wherein;
 a. a first modification is within the amino acid region WLLNRLINRLQNQGILLYYDIV (SEQ ID NO: 766) of the sequence of SEQ ID NO 1 or the homologous region in other species; and
 b. a second modification is selected from one or more of the amino acid regions VAIF (SEQ ID NO: 767), MGA, ENHNQ (SEQ ID NO: 742), FMRA (SEQ ID NO: 744), HAI, TKA, FHS, QADNA (SEQ ID NO: 771), MQK, SAAVCK (SEQ ID NO: 747), EAQA (SEQ ID NO: 772), TVR, KEC, TPEMGK (SEQ ID NO: 774), DHFQ (SEQ ID NO: 751), LAAG (SEQ ID NO: 775), APPVDN (SEQ ID NO: 762), FARHERKMLLDNHA (SEQ ID NO: 753), and YIDP (SEQ ID NO: 757) of the sequence of SEQ ID NO 1 or the homologous regions in other species.

When compared to the sequence of *Bos taurus* (cow) TdT; SEQ ID NO 2,
 a. a first modification is within the amino acid region QLLPKVINLWEKKGLLLYYDLV (SEQ ID NO: 778) of the sequence of SEQ ID NO 2 or the homologous region in other species; and
 b. a second modification is selected from one or more of the amino acid regions LVLF (SEQ ID NO: 779), MGA, NNYNH (SEQ ID NO: 796), FMRA (SEQ ID NO: 744), FTI, VKC, FRS, MSDKT (SEQ ID NO: 785), MQK, EAEA (SEQ ID NO: 788), AVW, KKI, SPGSAE (SEQ ID NO: 791), MCP, YATHERKMMLDNHA (SEQ ID NO: 798), and YIEP (SEQ ID NO: 799) of the sequence of SEQ ID NO 2 or the homologous regions in other species.

When compared to the sequence of *Mus musculus* (mouse) TdT; SEQ ID NO 3,
 a. a first modification is within the amino acid region QLLHKVTDFWKQQGLLLYCDIL (SEQ ID NO: 800) of the sequence of SEQ ID NO 3 or the homologous region in other species; and
 b. a second modification is selected from one or more of the amino acid regions LVLF (SEQ ID NO: 779), MGA, NNYNQ (SEQ ID NO: 818), FMRA (SEQ ID NO: 744), FPI, VKS, FRT, QSDKS (SEQ ID NO: 807), MQK, VSCVNR (SEQ ID NO: 809), EAEA (SEQ ID NO: 788), AVV, KMT, SPEATE (SEQ ID NO: 812), DHFQ (SEQ ID NO: 751), MCPYDR (SEQ ID NO: 817), YATHERKMMLDNHA (SEQ ID NO: 798), and YIEP (SEQ ID NO: 799) of the sequence of SEQ ID NO 3 or the homologous regions in other species.

The modifications can be chosen from any amino acid that differs from the wild type sequence. The amino acid can be a naturally occurring amino acid. The modified amino acid can be selected from ala, arg, asn, asp, cys, gin, glu, gly, his, ile, leu lys, met, phe, pro, ser, thr, trip, val, and sec.

For the purposes of brevity, the modifications are further described in relation to SEQ ID NO 1, but the modifications are applicable to the sequences from other species, for example those sequences listed above having sequences in the NCBI database. The sequence modifications also apply to truncated versions of SEQ ID NO 1.

The sequences can be modified at positions in addition to those regions described. Embodiments on the invention may include for example sequences having modifications to amino acids outside the defined positions, providing those sequences retain terminal transferase activity. Embodiments of the invention may include for example sequences having truncations of amino acids outside the defined positions, providing those sequences retain terminal transferase activity. For example the sequences may be BRCT truncated as described in application WO2018215803 where amino acids are removed from the N-terminus whilst retaining or improving activity. Alterations, additions, insertions or deletions or truncations to amino acid positions outside the claimed regions are therefore within the scope of the invention, providing that the claimed regions as defined are modified as claimed. The sequences described herein refer to TdT enzymes, which are typically at least 300 amino acids in length. All sequences described herein can be seen as having at least 300 amino acids. The claims do not cover peptide fragments or sequences which do not function as terminal transferase enzymes.

The modification within the region WLLNRLINRLQNQGILLYYDIV (SEQ ID NO: 766) or the corresponding region from other species help improve the solubility of the enzyme. The modification within the amino acid region WLLNRLINRLQNQGILLYYDIV (SEQ ID NO: 766) can be at one or more of the underlined amino acids.

Particular changes can be selected from W-Q, N-P, R-K, L-V, R-L, L-W, Q-E, N-K, Q-K or I-L.

The sequence WLLNRLINRLQNQGILLYYDIV (SEQ ID NO: 766) can be altered to QLLPKVINLWEKKGLLLYYDLV (SEQ ID NO: 778).

The second modification improves incorporation of nucleotides having a modification at the 3' position in comparison to the wild type sequence. The second modification can be selected from one or more of the amino acid regions VAIF (SEQ ID NO: 767), MGA, ENHNQ (SEQ ID NO: 742), FMRA (SEQ ID NO: 744), HAI, TKA, FHS, QADNA (SEQ ID NO: 771), MQK, SAAVCK (SEQ ID NO: 747), EAQA (SEQ ID NO: 772), TVR, KEC, TPEMGK (SEQ ID NO: 774), DHFQ (SEQ ID NO: 751), LAAG (SEQ ID NO: 775), APPVDN (SEQ ID NO: 762), FARHERKMLLDNHA (SEQ ID NO: 753), and YIDP (SEQ ID NO: 757) of the sequence of SEQ ID NO 1 or the homologous regions in other species. The second modification can be selected from two or more of the amino acid regions VAIF (SEQ ID NO: 767), EDN, MGA, ENHNQ (SEQ ID NO: 742), FMRA (SEQ ID NO: 744), HAI, TKA, FHS, QADNA (SEQ ID NO: 771), MQK, SAAVCK (SEQ ID NO: 747), EAQA (SEQ ID NO: 772), TVR, KEC, TPEMGK (SEQ ID NO: 774), DHFQ (SEQ ID NO: 751), LAAG (SEQ ID NO: 775), APPVDN (SEQ ID NO: 762), FARHERKMLLDNHA (SEQ ID NO: 753), and YIDP (SEQ ID NO: 757) of the sequence of SEQ ID NO 1 or the homologous regions in other species shown highlighted in the sequence below.

```
MLHIPIFPPIKKRQKLPESRNSCKYEVKFSEVAIFLVERKMGSSRRKFLTNLARSKGFRIEDVLSDAV

THVVAEDNSADELWQWLQNSSLGDLSKIEVLDISWFTECMGAGKPVQVEARHCLVKSCPVIDQYLEPS

TVETVSQYACQRRTTMENHNQIFTDAFAILAENAEFNESEGPCLAFMRAASLLKSLPHAISSSKDLEG

LPCLGDQTKAVIEDILEYGQCSKVQDVLCDDRYQTIKLFTSVFGVGLKTAEKWYRKGFHSLEEVQADN

AIHFTKMQKAGFLYYDDISAAVCKAEAQAIGQIVEETVRLIAPDAIVTLTGGFRRGKECGHDVDFLIT

TPEMGKEVWLLNRLINRLQNQGILLYYDIVESTFDKTRLPCRKFEAMDHFQKCFAIIKLKKELAAGRV

QKDWKAIRVDFVAPPVDNFAFALLGWTGSRQFERDLRRFARHERKMLLDNHALYDKTKKIFLPAKTEE

DIFAHLGLDYIDPWQRNA
```

The identified positions commence at positions V32, M108, F182, T212, D271, M279, E298, A421, L456, Y486. Modifications disclosed herein contain at least one modification at the defined positions.

In the sequence below the modified regions are numbered thus (SEQ ID NO: 1)

acid can be in the region EAQA (SEQ ID NO: 772). The modified amino acid can be in the region APP. The modified amino acid can be in the region LDNHA (SEQ ID NO: 841). The modified amino acid can be in the region YIDP (SEQ ID NO: 757).

```
MLHIPIFPPIKKRQKLPESRNSCKYEVKFSEVAIFLVERKMGSSRRKFLTNLARSKGFRIEDVLSDAV

THVVAEDNSADELWQWLQNSSLGDLSKIEVLDISWFTECMGAGKPVQVEARHCLVKSCPVIDQYLEPS

TVETVSQYACQRRTTMENHNQIFTDAFAILAENAEFNESEGPCLAFMRAASLLKSLPHAISSSKDLEG

LPCLGDQTKAVIEDILEYGQCSKVQDVLCDDRYQTIKLFTSVFGVGLKTAEKWYRKGFHSLEEVQADN

AIHFTKMQKAGFLYYDDISAAVCKAEAQAIGQIVEETVRLIAPDAIVTLTGGFRRGKECGHDVDFLIT

TPEMGKEVWLLNRLINRLQNQGILLYYDIVESTFDKTRLPCRKFEAMDKFQKCFAIIKLKKELAAGRV

QKDWKAIRVDFVAPPVDNFAFALLGWTGSRQFERDLRRFARHERKMLLDNHALYDKTKKIFLPAKTEE

DIFAHLGLDYIDPWQRNA
```

WLLNRLINRLQNQGILLYYDIV (SEQ ID NO: 766), 349 to 370
VAIF (SEQ ID NO: 767), 32 to 35
MGA, 108 to 110
MENHNQI (SEQ ID NO: 763), 152 to 158
SEGPCLAFMRA (SEQ ID NO: 743), 175 to 185
HAISSS (SEQ ID NO: 768), 194 to 199
DQTKA (SEQ ID NO: 769), 210 to 214
KGFHS (SEQ ID NO: 770), 260 to 264
QADNA (SEQ ID NO: 771), 269 to 273
HFTKMQK (SEQ ID NO: 745), 275 to 281
SAAVCK (SEQ ID NO: 747), 291 to 296
EAQA (SEQ ID NO: 772), 298 to 301
TVRLI (SEQ ID NO: 773), 309 to 313
GKEC (SEQ ID NO: 749), 328 to 331
TPEMGK (SEQ ID NO: 774), 341 to 346
DHFQK (SEQ ID NO: 750), 388 to 392
LAAG (SEQ ID NO: 775), 403 to 406
APPVDNF (SEQ ID NO: 760), 421 to 427
FARHERKMLLDNHALYDKTKK (SEQ ID NO: 754), 447 to 467
DYIDP (SEQ ID NO: 756), 485 to 489

The modified amino acid can be in the region FMRA (SEQ ID NO: 744). The modified amino acid can be in the region QADNA (SEQ ID NO: 771). The modified amino The region FARHERKMLLDNHA (SEQ ID NO: 753) is advantageous for removing substrate biases in modifications. The FARHERKMLLDNHA (SEQ ID NO: 753) region appears highly conserved across species.

The modification selected from one or more of the amino acid regions FMRA (SEQ ID NO: 744), QADNA (SEQ ID NO: 771), EAQA (SEQ ID NO: 772), APP, FARHERKMLLDNHA (SEQ ID NO: 753), and YIDP (SEQ ID NO: 757) can be at the underlined amino acid(s).

Rather than the invention being described by modifications in defined domains, the sequences can be defined by modifications at certain defined amino acids. Described herein are modified terminal deoxynucleotidyl transferase (TdT) enzymes comprising amino acid modifications when compared to a wild type sequence SEQ ID NO 1 or a truncated version thereof or the homologous amino acid sequence of a terminal deoxynucleotidyl transferase (TdT) enzyme in other species, wherein the amino acid is modified at one or more of the amino acids A53, V68, V71, E97, I101, G109, Q115, V116, S125, T137, Q143, M152, N154, H155, Q157, I158, I165, N169, S175, G177, C179, L180, A181, M183, A195, S197, S198, S199, K200, D210, Q211, T212, K213, A214, E217, T239, K260, F262, S264, Q269, D271, N272, A273, H275, T277, K281, S291, K296, Q300, T309, R311, L312, I313, G328, E330, C331, T341, P342, E343, M344, G345, K346, N352, R353, L354, I355, N356, L358, N360, Q361, G362, I363, Y366, Y367, D368, V370, H389, K392, L403, A405, G406, D411, A421, P422, V424, N426, F427, R438, F447, R452, L453, L455, Y462, K464, T465, K467, D485, I487 and/or D488.

Described herein are modified terminal deoxynucleotidyl transferase (TdT) enzymes comprising amino acid modifications when compared to a wild type sequence SEQ ID NO 1 or the homologous amino acid sequence of a terminal deoxynucleotidyl transferase (TdT) enzyme in other species, wherein the amino acid is modified at one or more of the amino acids V32, A33, I34, F35, A53, V68, V71, E97, I101, M108, G109, A110, Q115, V116, S125, T137, Q143, M152, E153, N154, H155, N156, Q157, I158, I165, N169, N173, S175, E176, G177, P178, C179, L180, A181, F182, M183, R184, A185, L188, H194, A195, I196, S197, S198, S199, K200, E203, G204, D210, Q211, T212, K213, A214, I216, E217, D218, L220, Y222, V228, D230, Q238, T239, L242, L251, K260, G261, F262, H263, S264, L265, E267, Q269, A270, D271, N272, A273, H275, F276, T277, K278, M279, Q280, K281, S291, A292, A293, V294, C295, K296, E298, A299, Q300, A301, Q304, I305, T309, V310, R311, L312, I313, A314, I318, V319, T320, G328, K329, E330, C331, L338, T341, P342, E343, M344, G345, K346, W349, L350, L351, N352, R353, L354, I355, N356, R357, L358, Q359, N360, Q361, G362, I363, L364, L365, Y366, Y367, D368, I369, V370, K376, T377, C381, K383, D388, H389, F390, Q391, K392, F394, I397, K398, K400, K401, E402, L403, A404, A405, G406, R407, D411, A421, P422, P423, V424, D425, N426, F427, A430, R438, F447, A448, R449, H450, E451, R452, K453, M454, L455, L456, D457, N458, H459, A460, L461, Y462, D463, K464, T465, K466, K467, T474, D477, D485, Y486, I487, D488, P489.

Specific amino acid changes can include any one of A53G, V68I, V71I, E97A, I101V, G109E, G109R, Q115E, V116I, V116S, S125R, T137A, Q143P, M152L, M152T, N154H, H155C, H155N, H155R, Q157K, Q157R, I158V, I158L, I158M, I165V, N169R, N173R, S175N, G177S, G177V, G177D, C179A, C179S, L180V, A181E, M183R, L188V, A195T, A195P, S197I, S197L, S198R, S198C, S199L, K200R, E203Q, G204D, D210E, Q211R, T212S, K213S, A214R, A214C, A214G, I216M, E217Q, D218E, L220I, L220F, L220Y, Y222C, V228A, D230E, Q238K, T239S, L242Q, L251P, K260M, F262L, L265F, S264T, E267D, Q269K, D271N, D271E, N272K, A273S, A273T, H275Q, T277S, K281R, S291N, S291T, K296R, Q300D, Q304R, Q304C, Q304H, I305V, T309A, R311W, R311H, L312G, L312K, L312A, I313M, A314T, I318L, V319L, T320A, G328A, E330N, E330S, C331I, L338I, T341S, P342A, E343G, E343Q M344A, M344Q M344K, G345R, K346R, N352Q, K353R, K353D, V354I, V354L, I355V, I355M, N356R, N356D, W358L, N360K, Q361K, G362E, I363L, Y366F, Y367C, D368H, D368E, V370I, K376I, T377S, T377L, T377A, C381S, K383R, H389N, H389A, K392Q F394W, I397L, K398R, K400E, K400N, K401A, K401Q, E402Q, L403Q, L403R, A405D, G406R, R407C, D411N, A421L, A421M, A421V, P422A, P422C, V424Y, V424I, V424A, N426R, N426C, F427Y, A430T, R438K, F447W, R452K, L455I, K453R, Y462F, K464R, T465R, K467R, T474S, D477E, D485E, I487V, and/or D488P.

Amino acid changes include any two or more of A53G, V68I, V71I, E97A, I101V, G109E, G109R, Q115E, V116I, V116S, S125R, T137A, Q143P, M152L, M152T, N154H, H155C, H155N, H155R, Q157K, Q157R, I158V, I158L, I158M, I165V, N169R, N173R, S175N, G177S, G177V, G177D, C179A, C179S, L180V, A181E, M183R, L188V, A195T, A195P, S197I, S197L, S198R, S198C, S199L, K200R, E203Q, G204D, D210E, Q211R, T212S, K213S, A214R, A214C, A214G, I216M, E217Q, D218E, L220I, L220F, L220Y, Y222C, V228A, D230E, Q238K, T239S, L242Q, L251P, K260M, F262L, L265F, S264T, E267D, Q269K, D271N, D271E, N272K, A273S, A273T, H275Q, T277S, K281R, S291N, S291T, K296R, Q300D, Q304R, Q304C, Q304H, I305V, T309A, R311W, R311H, L312G, L312K, L312A, I313M, A314T, I318L, V319L, T320A, G328A, E330N, E330S, C331I, L338I, T341S, P342A, E343G, E343Q M344A, M344Q M344K, G345R, K346R, N352Q, K353R, K353D, V354I, V354L, I355V, I355M, N356R, N356D, W358L, N360K, Q361K, G362E, I363L, Y366F, Y367C, D368H, D368E, V370I, K376I, T377S, T377L, T377A, C381S, K383R, H389N, H389A, K392Q F394W, I397L, K398R, K400E, K400N, K401A, K401Q, E402Q, L403Q, L403R, A405D, G406R, R407C, D411N, A421L, A421M, A421V, P422A, P422C, V424Y, V424I, V424A, N426R, N426C, F427Y, A430T, R438K, F447W, R452K, L455I, K453R, Y462F, K464R, T465R, K467R, T474S, D477E, D485E, I487V, and/or D488P.

The modification of QADNA (SEQ ID NO: 771) to KADKA (SEQ ID NO: 842), QADKA (SEQ ID NO: 843), KADNA (SEQ ID NO: 844), QADNS (SEQ ID NO: 845), KADNT (SEQ ID NO: 846), or QADNT (SEQ ID NO: 847) is advantageous for the incorporation of 3'-O-modified nucleoside triphosphates to the 3'-end of nucleic acids and removing substrate biases during the incorporation of modified nucleoside triphosphates. The modification of APPVDN (SEQ ID NO: 762) to MCPVDN (SEQ ID NO: 848), MPPVDN (SEQ ID NO: 849), ACPVDR (SEQ ID NO: 850), VPPVDN (SEQ ID NO: 851), LPPVDR (SEQ ID NO: 852), ACPYDN (SEQ ID NO: 853), LCPVDN (SEQ ID NO: 854), or MAPVDN (SEQ ID NO: 855) is advantageous for the incorporation of 3'-O-modified nucleoside triphosphates to the 3'-end of nucleic acids and removing substrate biases during the incorporation of modified nucleoside triphosphates. The modification of FARHERKMLLDRHA (SEQ ID NO: 752) to WARHERKMILDNHA (SEQ ID NO: 856), FARHERKMILDNHA (SEQ ID NO: 857), WARHERKMLLDNHA (SEQ ID NO: 858), FARHERKMLLDRHA (SEQ ID NO: 752), or FARHEKKMLLDNHA (SEQ ID NO: 859) is also advantageous for the incorporation of 3'-O-modified nucleoside triphosphates to the 3'-end of nucleic acids and removing substrate biases during the incorporation of modified nucleoside triphosphates.

The modification can be selected from one or more of the following sequences FRRA (SEQ ID NO: 860), QADKA (SEQ ID NO: 843), EADA (SEQ ID NO: 861), MPP, FARHERKMLLDRHA (SEQ ID NO: 752), and YIPP (SEQ ID NO: 862). Included is a modified terminal deoxynucleotidyl transferase (TdT) enzyme wherein the second modification is selected from two or more of the following sequences FRRA (SEQ ID NO: 860), QADKA (SEQ ID NO: 843), EADA (SEQ ID NO: 861), MPP, FARHERKMLLDRHA (SEQ ID NO: 752), and YIPP (SEQ ID NO: 862). Included is a modified terminal deoxynucleotidyl transferase (TdT) enzyme wherein the second modification contains each of the following sequences FRRA (SEQ ID NO: 860), QADKA (SEQ ID NO: 843), EADA (SEQ ID NO: 861), MPP, FARHERKMLLDRHA (SEQ ID NO: 752), and YIPP (SEQ ID NO: 862).

Figure 5:
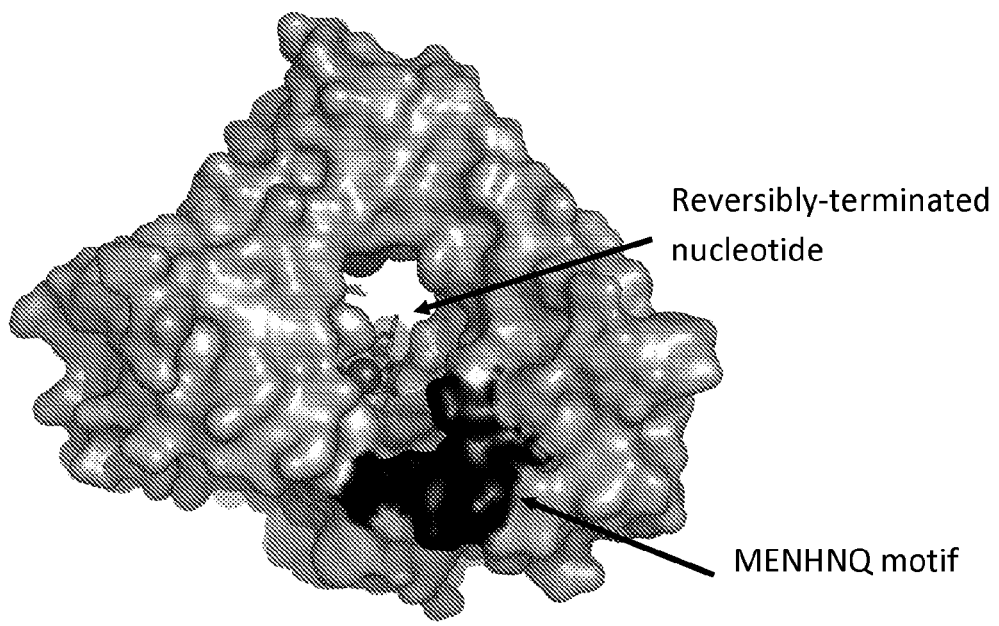
FIG. 5. (SEQ ID NO: 741) Surface representation of spotted gar TdT homology structure modelled onto the crystal structure of an engineered TdT variant as described in FIG. 4 with MENHNQI (SEQ ID NO: 763) motif, which includes the ENHNQ (SEQ ID NO: 742) motif, highlighted in black. TdT contains two entrances to the nucleotidyl transferase active site in which the DNA initiator and reversibly terminated dNTP can enter and bind. Determined by modelling and visual inspection of the active site, the MENHNQI (SEQ ID NO: 763) and ENHNQ (SEQ ID NO: 742) motifs controls access to the nucleotidyl transferase active site, and the mutations shown in this patent demonstrate that mutating this motif results in increased TdT incorporation activity of reversibly terminated nucleotides.
Figure 6:
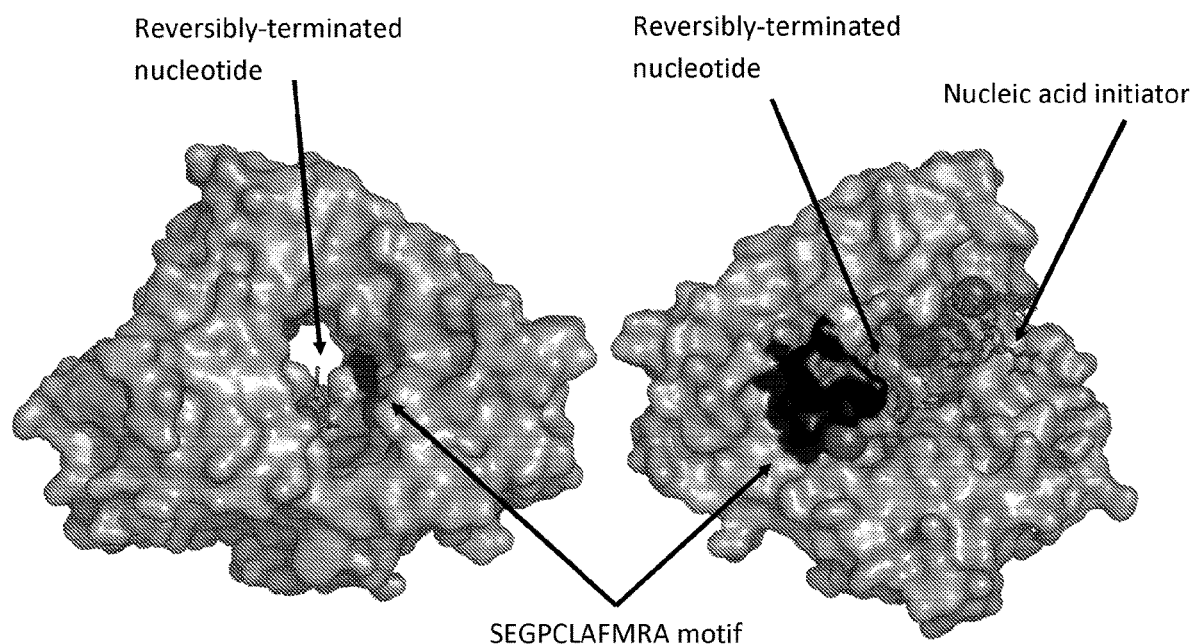
FIG. 6. Surface representations (right is 180 degree rotation of left view) of spotted gar TdT homology structure modelled onto the crystal structure of an engineered TdT variant as described in FIG. 4 with SEGPCLAFMRA (SEQ ID NO: 743), which includes the FMRA (SEQ ID NO: 744) motif, highlighted in black. TdT contains two entrances to the nucleotidyl transferase active site in which the DNA initiator and reversibly terminated dNTP can enter and bind. Determined by modelling and visual inspection of the active site, the SEGPLCLAFMRA (SEQ ID NO: 764) and FMRA (SEQ ID NO: 744) motifs (1) control access of the reversibly terminated nucleotide to the nucleotidyl transferase active site through steric effects and electrostatic interactions and (2) directly packs against the critical TGSR (SEQ ID NO: 759) motif, which directly contacts the reversibly terminated nucleotide. Specifically in relation to the TGSR (SEQ ID NO: 759) motif, the SEGPLCLAFMRA (SEQ ID NO: 764) and FMRA (SEQ ID NO: 744) motifs directly contact and modulate the positioning of R438, which directly contacts the reversibly terminated nucleotide. Mutations shown in this patent demonstrate that mutating these motifs result in increased TdT incorporation activity of reversibly terminated nucleotides.

Crystal structures shown herein show the following domains, which may be preferred as domains to modify:

FIG. 5. MENHNQI (SEQ ID NO: 763) motif (152 to 158), which includes the ENHNQ (SEQ ID NO: 742) motif FIG. 6. SEGPCLAFMRA (SEQ ID NO: 743) (175 to 185), which includes the FMRA (SEQ ID NO: 744) motif, highlighted in black.

Figure 7:
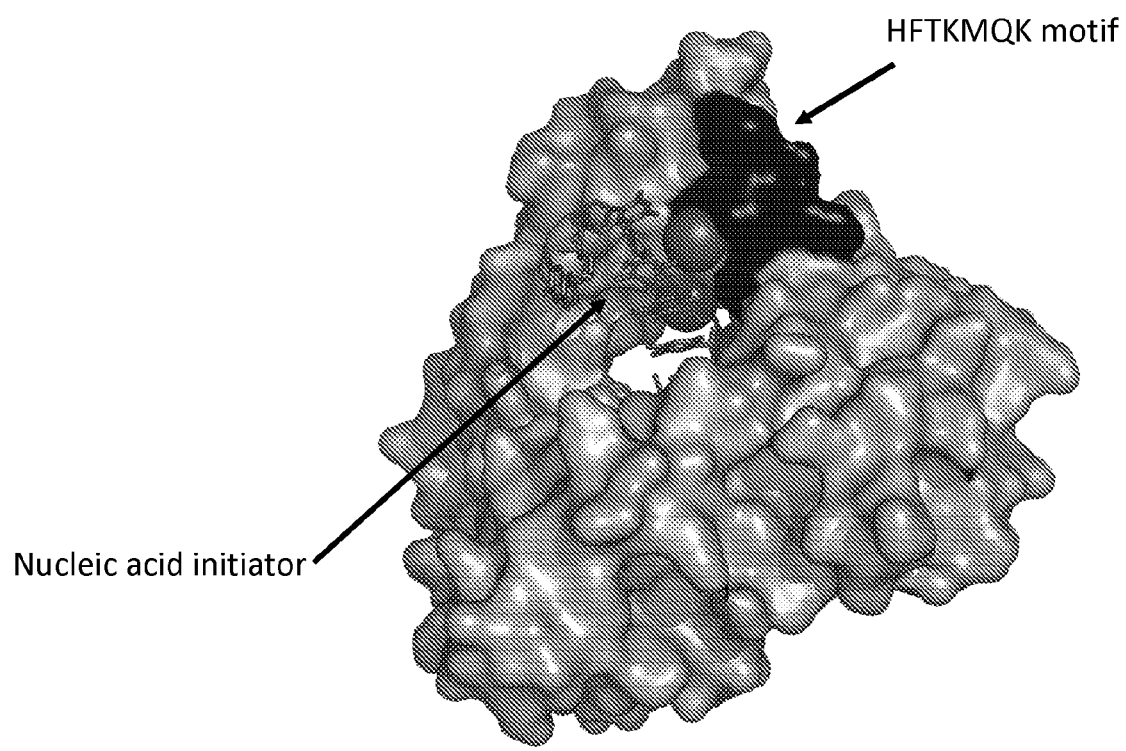
FIG. 7. Surface representation of spotted gar TdT homology structure modelled onto the crystal structure of an engineered TdT variant as described in FIG. 4 with HFTKMQK (SEQ ID NO: 745) motif, which includes the MQK motif, highlighted in black. TdT contains two entrances to the nucleotidyl transferase active site in which the DNA initiator and reversibly terminated dNTP can enter and bind. Determined by modelling and visual inspection of the active site, the HFTKMQK (SEQ ID NO: 745) and MQK motifs bind to the nucleic acid initiator and assist in positioning the 3'-end of the initiator for nucleophilic attack against the incoming nucleotide. Mutations shown in this patent demonstrate that mutating this motif results in increased TdT incorporation activity of reversibly terminated nucleotides.

FIG. 7. HFTKMQK (SEQ ID NO: 745) motif (275 to 281), which includes the MQK motif, highlighted in black.

Figure 8:
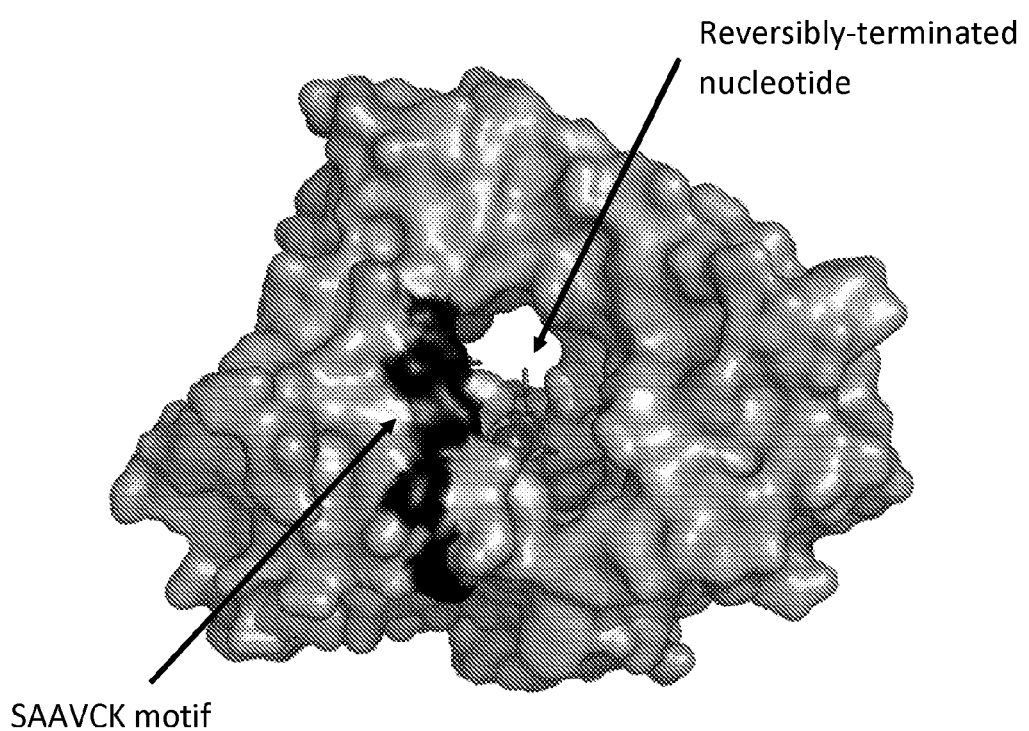
FIG. 8. Surface representation of spotted gar TdT homology structure modelled onto the crystal structure of an engineered TdT variant as described in FIG. 4 with SAAVCK (SEQ ID NO: 747) motif highlighted in black. TdT contains two entrances to the nucleotidyl transferase active site in which the DNA initiator and reversibly terminated dNTP can enter and bind. Determined by modelling and visual inspection of the active site, the SAAVCK (SEQ ID NO: 747) motif controls reversibly terminated nucleotide access to the nucleotidyl transferase active site. Mutations shown in this patent demonstrate that mutating this motif results in increased TdT incorporation activity of reversibly terminated nucleotides.

FIG. 8. SAAVCK (SEQ ID NO: 747) motif (291 to 296) highlighted in black.

Figure 9:
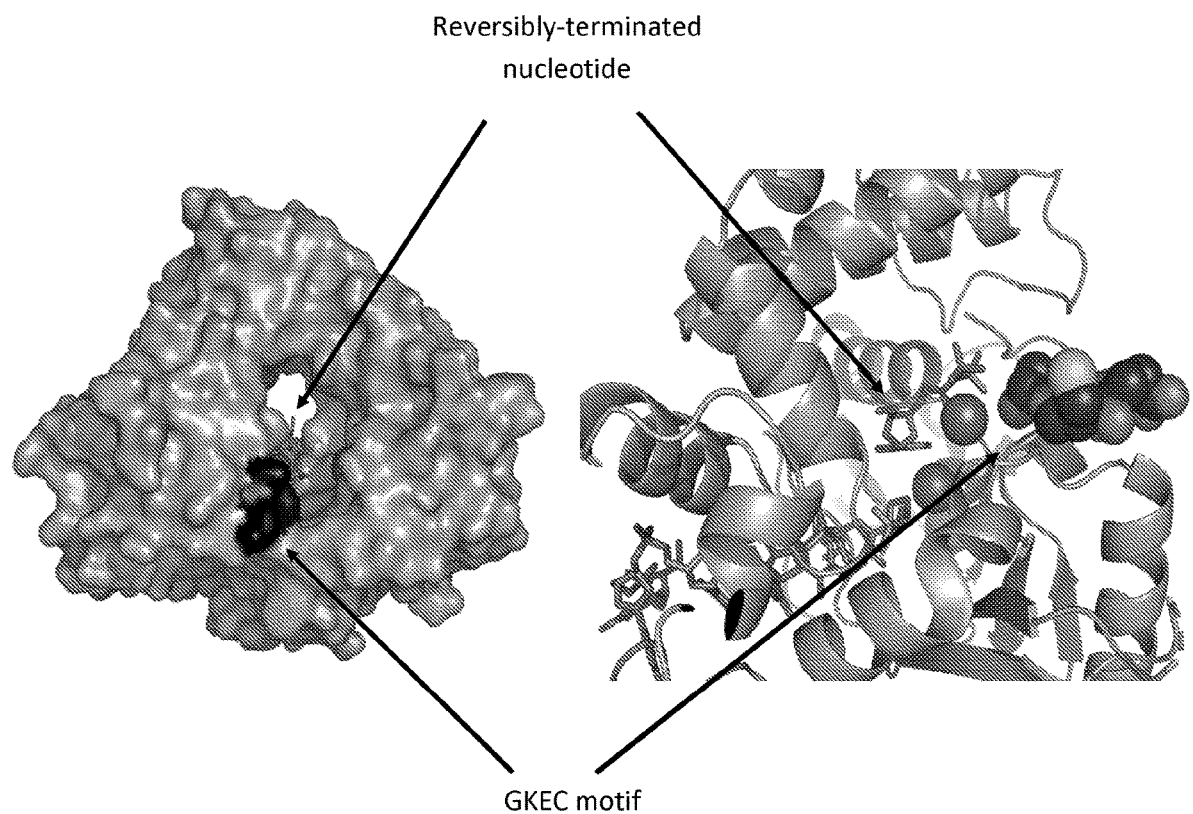
FIG. 9. Surface (left) and cartoon/sphere (right) representation of spotted gar TdT homology structure modelled onto the crystal structure of an engineered TdT variant as described in FIG. 4 with the GKEC (SEQ ID NO: 749) motif, which includes the KEC motif, highlighted in black. TdT contains two entrances to the nucleotidyl transferase active site in which the DNA initiator and reversibly terminated dNTP can enter and bind. Determined by modelling and visual inspection of the active site, the GKEC (SEQ ID NO: 749) and KEC motifs control reversibly terminated nucleotide access to and direct binding to the nucleotidyl transferase active site. Mutations shown in this patent demonstrate that mutating this motif results in increased TdT incorporation activity of reversibly terminated nucleotides.

FIG. 9. GKEC (SEQ ID NO: 749) motif (328 to 331), which includes the KEC motif, highlighted in black.

Figure 10:
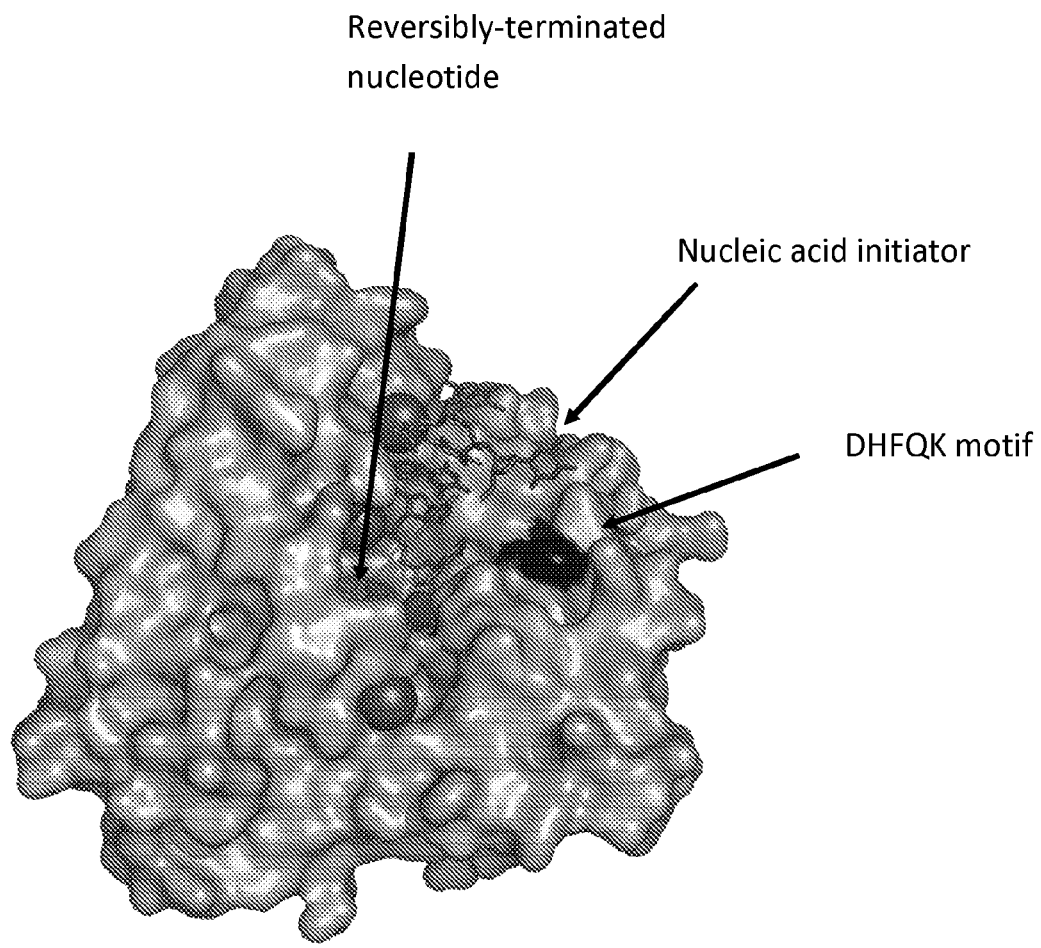
FIG. 10. Surface representation of spotted gar TdT homology structure modelled onto the crystal structure of an engineered TdT variant as described in FIG. 4 with the DHFQK (SEQ ID NO: 750) motif, which includes the DHFQ (SEQ ID NO: 751) motif, highlighted in black. TdT contains two entrances to the nucleotidyl transferase active site in which the DNA initiator and reversibly terminated dNTP can enter and bind. Determined by modelling and visual inspection of the active site, the DHFQK (SEQ ID NO: 750) and DHFQ (SEQ ID NO: 751) motifs control nucleic acid initiator access to the nucleotidyl transferase active site by sterically impinging on the nucleic acid initiator. Mutations shown in this patent demonstrate that mutating this motif results in increased TdT incorporation activity of reversibly terminated nucleotides.

FIG. 10. DHFQK (SEQ ID NO: 750) motif (388 to 392), which includes the DHFQ (SEQ ID NO: 751) motif, highlighted in black.

Figure 11:
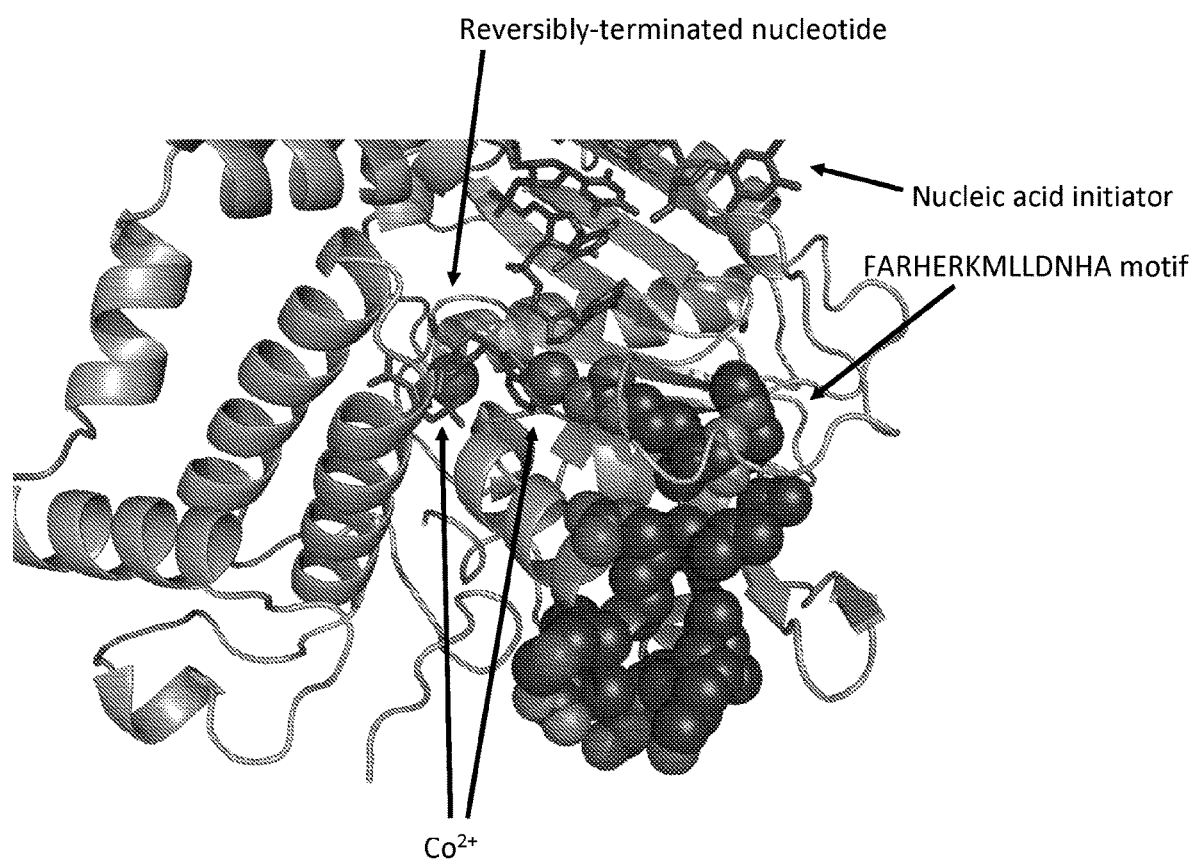
FIG. 11. Cartoon representation of an engineered TdT variant crystal structure as described in FIG. 4 bound to a DNA initiator and dATP-ONH$_2$ with the FARHERKMLL-DNHA (SEQ ID NO: 753) motif highlighted in black spheres. TdT contains two entrances to the nucleotidyl transferase active site in which the DNA initiator and reversibly terminated dNTP can enter and bind. Determined by modelling and visual inspection of the active site, the FARHERKMLLDNHA (SEQ ID NO: 753) motif controls nucleotide and nucleic acid initiator binding in the nucleotidyl transferase active site by sterically impinging on the nucleotide and initiator. Additionally, motif FARHERKMLLDNHA (SEQ ID NO: 753) is mutated to FARHERKMLLDRHA (SEQ ID NO: 752). The Asn to Arg mutation results in the Arg residue directly binding one out of two of the catalytic cobalt ions, which is required for activity. Mutations shown in this patent demonstrate that mutating residues within this motif adjust the positioning of critical amino acids in contact with either a Co$^{2+}$, the reversibly terminated nucleotide, and/or the nucleic acid initiator to result in increased TdT incorporation activity of reversibly terminated nucleotides.

FIG. 11. FARHERKMLLDNHA (SEQ ID NO: 753) motif (447 to 460) highlighted in black spheres. Additionally, motif FARHERKMLLDNHA (SEQ ID NO: 753) is mutated to FARHERKMLLDRHA (SEQ ID NO: 752).

Figure 12:
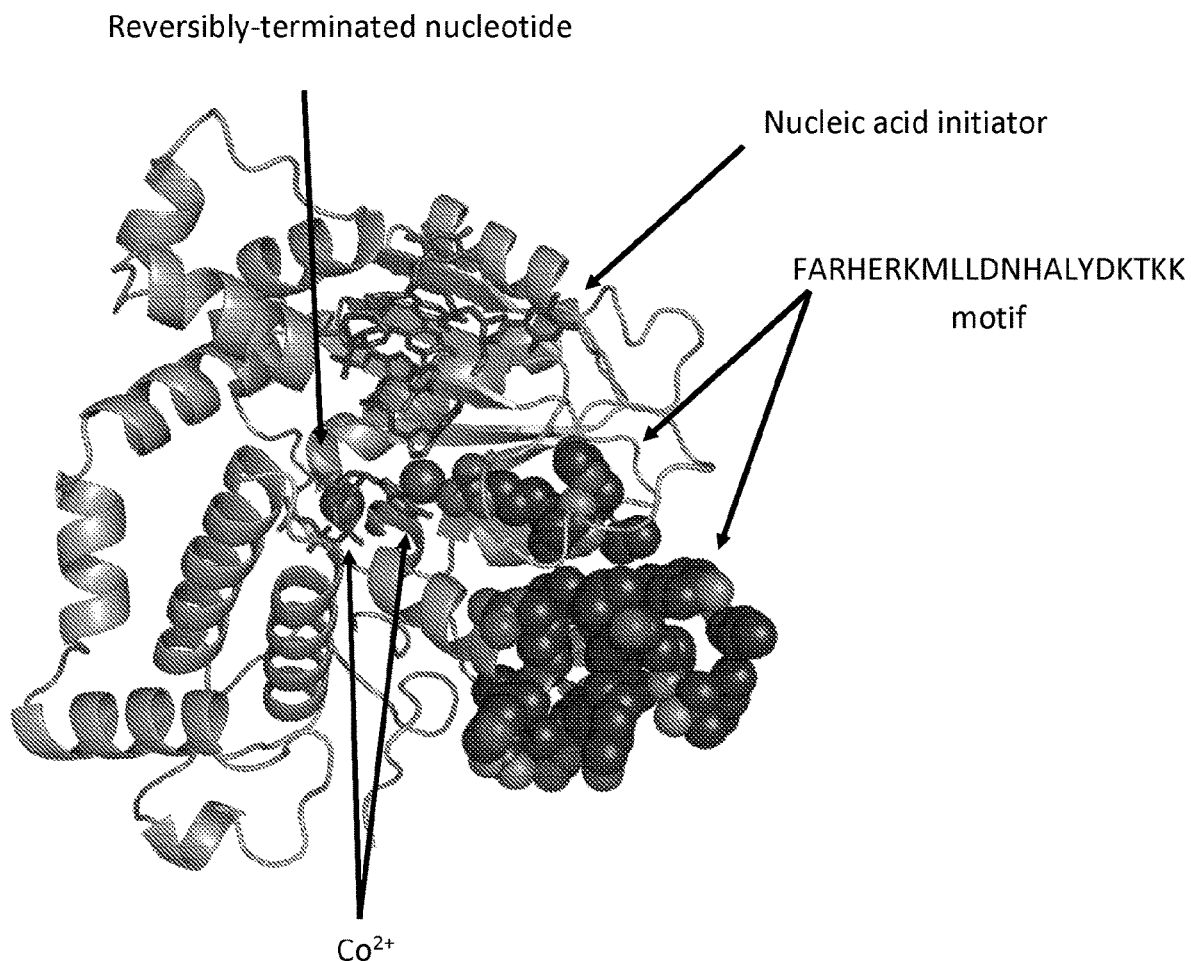
FIG. 12. Cartoon representation of an engineered TdT variant crystal structure as described in FIG. 4 bound to a DNA initiator and dATP-ONH$_2$ with the FARHERKMLL-DNHALYDKTKK (SEQ ID NO: 754) motif highlighted in black spheres. TdT contains two entrances to the nucleotidyl transferase active site in which the DNA initiator and reversibly terminated dNTP can enter and bind. Determined by modelling and visual inspection of the active site, the FARHERKMLLDNHALYDKTKK (SEQ ID NO: 754) motif controls nucleotide and nucleic acid initiator binding in the nucleotidyl transferase active site by sterically impinging on the nucleotide and initiator. Additionally, motif FARHERKMLLDNHALYDKTKK (SEQ ID NO: 754) is mutated to FARHERKMLLDRHALYDKTKK (SEQ ID NO: 755). The Asn to Arg mutation results in the Arg residue directly binding one out of two of the catalytic cobalt ions, which is required for activity. Mutations shown in this patent demonstrate that mutating residues within this motif adjust the positioning of critical amino acids in contact with either a Co$^{2+}$, the reversibly terminated nucleotide, and/or the nucleic acid initiator to result in increased TdT incorporation activity of reversibly terminated nucleotides.

FIG. 12. FARHERKMLLDNHALYDKTKK (SEQ ID NO: 754) motif (447 to 467) highlighted in black spheres. Additionally, motif FARHERKMLLDNHALYDKTKK (SEQ ID NO: 754) is mutated to FARHERKMLLDRHALYDKTKK (SEQ ID NO: 755).

Figure 13:
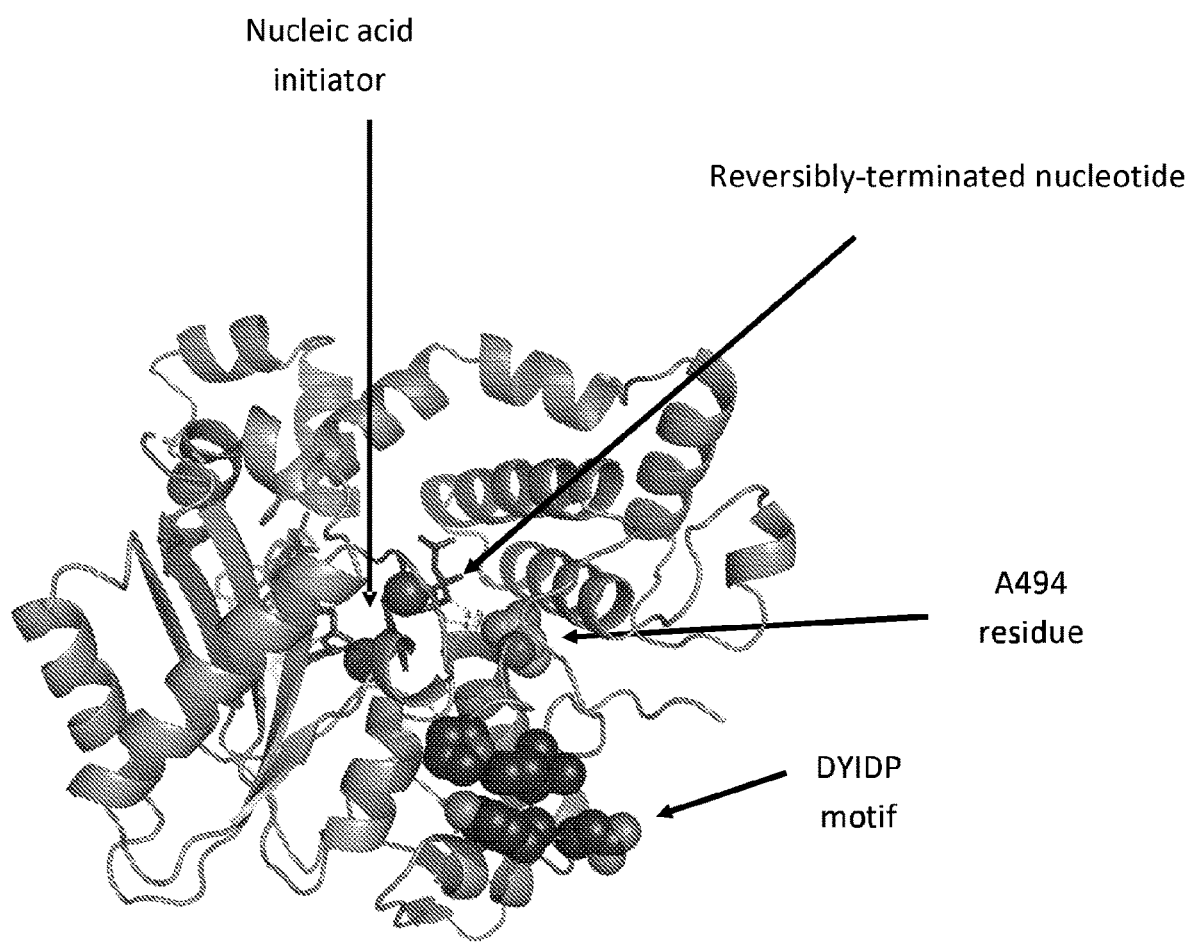
FIG. 13. Cartoon representation of an engineered TdT variant crystal structure as described in FIG. 4 bound to a DNA initiator and dATP-ONH$_2$ with the DYIDP (SEQ ID NO: 756) motif, which contains the YIDP (SEQ ID NO: 757) motif, highlighted in black spheres. TdT contains two entrances to the nucleotidyl transferase active site in which the DNA initiator and reversibly terminated dNTP can enter and bind. Determined by modelling and visual inspection of the active site, the DYIDP (SEQ ID NO: 756) and YIDP (SEQ ID NO: 757) motifs control nucleotide binding in the nucleotidyl transferase active site by modulating the positioning of A494 within the active site. This most C-terminal residue (Ala494) sterically impinges upon the incoming nucleotide. Mutating the YIDP (SEQ ID NO: 757) motif, modulates the positioning of the most C-terminal Ala residue resulting in increased TdT incorporation activity of reversibly terminated nucleotides.

FIG. 13. DYIDP (SEQ ID NO: 756) motif (485 to 489), which contains the YIDP (SEQ ID NO: 757) motif, highlighted in black spheres.

Figure 14:
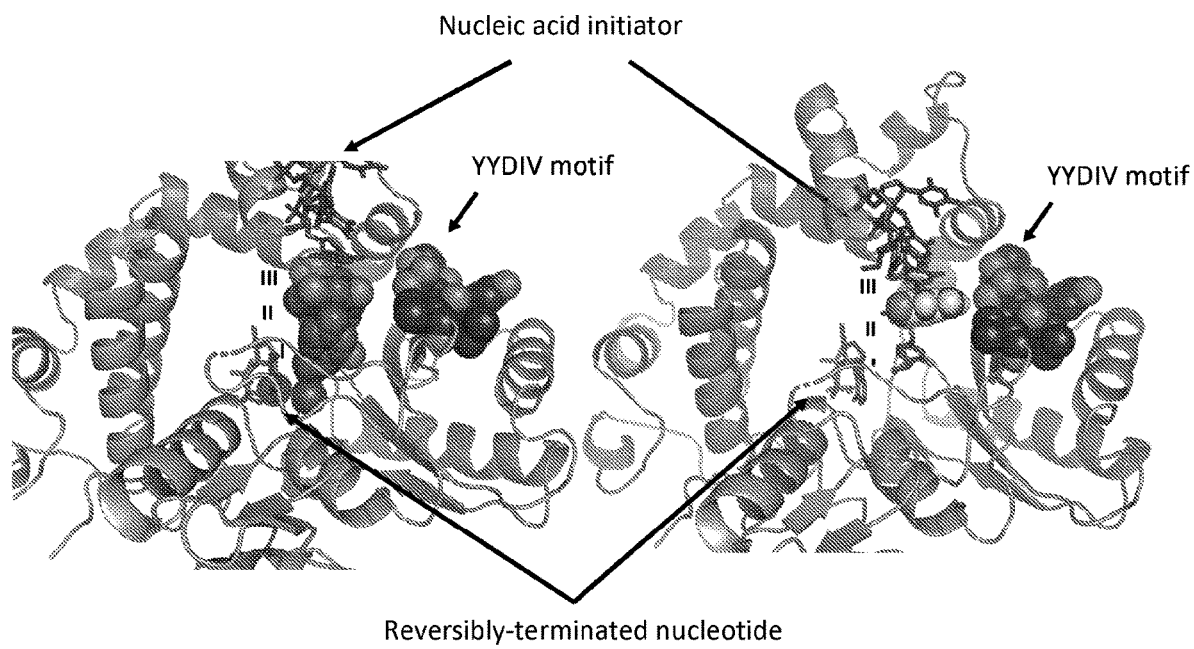
FIG. 14. Cartoon representation of an engineered TdT variant crystal structure as described in FIG. 4 bound to a DNA initiator and dATP-ONH$_2$ with the YYDIV (SEQ ID NO: 758) motif highlighted in black spheres. TdT contains two entrances to the nucleotidyl transferase active site in which the DNA initiator and reversibly terminated dNTP can enter and bind. Determined by modelling and visual inspection of the active site, the YYDIV (SEQ ID NO: 758) motif controls positioning of the nucleic acid initiator by sterically impinging upon the antepenultimate (III), penultimate (II), and ultimate (I) 3'-nucleotide in the nucleic acid initiator. In particular, this motif impinges upon pyrimidines (left, as crystallized, I & II shown in sphere representation), but especially purines (right, II modelled into the structure as a purine). Mutating the YYDIV (SEQ ID NO: 758) motif, modulates the positioning and access of the nucleic acid initiator into the nucleotidyl transferase active site resulting in increased TdT incorporation activity of reversibly terminated nucleotides.

FIG. 14. YYDIV (SEQ ID NO: 758) motif (366 to 370) highlighted in black spheres.

Figure 15:
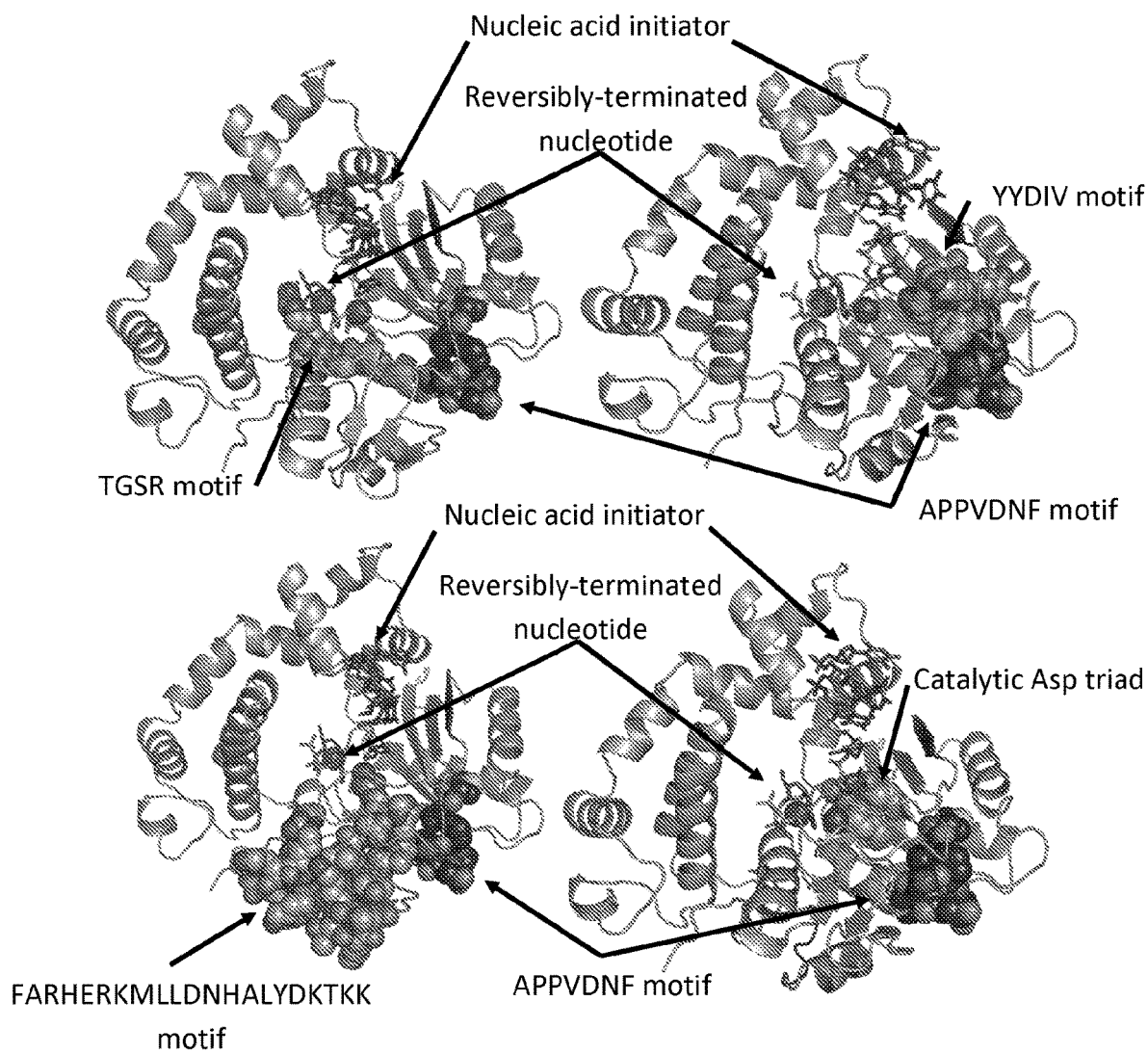
FIG. 15. Cartoon representation of an engineered TdT variant crystal structure as described in FIG. 4 bound to a DNA initiator and dATP-ONH$_2$ with the APPVDNF (SEQ ID NO: 760), which contains the APPVDN (SEQ ID NO: 762) motif, motif highlighted in black spheres. In the structure, the APPVDNF (SEQ ID NO: 760) motif is shown with an Ala to Met mutation to MPPVDNF (SEQ ID NO: 761). Through modelling, it was determined that the APPVDNF (SEQ ID NO: 760) and APPVDN (SEQ ID NO: 762) motifs control positioning of the following motifs by directly packing against the YYDIV (SEQ ID NO: 758) (upper right) and FARHERKMLLDNHALYDKTKK (SEQ ID NO: 754) (lower left) motifs, both of which are shown in light grey spheres. Additionally determined through modelling, the APPVDNF (SEQ ID NO: 760) and APPVDN (SEQ ID NO: 762) motifs control positioning of the following motifs by determining the loop conformation of the TGSR (SEQ ID NO: 759) motif (upper left) and the catalytic triad of aspartates (lower right) critical to the nucleotidyl transferase mechanism, both of which are shown in light grey spheres. Mutations in the APPVDNF (SEQ ID NO: 760) and APPVDN (SEQ ID NO: 762) motifs directly influence how the aforementioned critical protein motifs to modulate their contacts with the reversibly terminated nucleotide and nucleic acid initiator. Mutations in the APPVDNF (SEQ ID NO: 760) and APPVDN (SEQ ID NO: 762) motifs have been shown in this patent to result in increased TdT incorporation activity of reversibly terminated nucleotides.

FIG. 15. APPVDNF (SEQ ID NO: 760), which contains the APPVDN (SEQ ID NO: 762) motif (421 to 427), motif highlighted in black spheres. In the structure, the APPVDNF (SEQ ID NO: 760) motif is shown with an Ala to Met mutation to MPPVDNF (SEQ ID NO: 761).

In order to aid purification of the expressed sequence, the amino acid can be further modified. For example the amino acid sequence can contain one or more further histidine residues at the terminus. Included is a modified terminal deoxynucleotidyl transferase (TdT) enzyme comprising any one of SEQ ID NOs 4 to 173 or a truncated version thereof. Sequences 4-173 are the full length sequences derived from the spotted gar. Included is a modified terminal deoxynucleotidyl transferase (TdT) enzyme comprising any one of SEQ ID NOs 174 to 343. Sequences 174 to 343 are N-truncated sequences as spotted gar/bovine chimeras. Sequences 344 to 727 are spotted Gar sequences in truncated form. Additionally, for these sequences, there is an N-terminal sequence that is incorporated simply as a protease cleavage site (MENLYFQG . . . )(SEQ ID NO: 765).

Also disclosed is a method of nucleic acid synthesis, which comprises the steps of:
(a) providing an initiator oligonucleotide;
(b) adding a 3'-blocked nucleoside triphosphate to said initiator oligonucleotide in the presence of a terminal deoxynucleotidyl transferase (TdT) as defined herein;
(c) removal of all reagents from the initiator oligonucleotide;
(d) cleaving the blocking group in the presence of a cleaving agent; and
(e) removal of the cleaving agent.

The method can add greater than 1 nucleotide by repeating steps (b) to (e).

References herein to 'nucleoside triphosphates' refer to a molecule containing a nucleoside (i.e. a base attached to a deoxyribose or ribose sugar molecule) bound to three phosphate groups. Examples of nucleoside triphosphates that contain deoxyribose are: deoxyadenosine triphosphate (dATP), deoxyguanosine triphosphate (dGTP), deoxycytidine triphosphate (dCTP) or deoxythymidine triphosphate (dTTP). Examples of nucleoside triphosphates that contain ribose are: adenosine triphosphate (ATP), guanosine triphosphate (GTP), cytidine triphosphate (CTP) or uridine triphosphate (UTP). Other types of nucleosides may be bound to three phosphates to form nucleoside triphosphates, such as naturally occurring modified nucleosides and artificial nucleosides.

Therefore, references herein to '3'-blocked nucleoside triphosphates' refer to nucleoside triphosphates (e.g., dATP, dGTP, dCTP or dTTP) which have an additional group on the 3' end which prevents further addition of nucleotides, i.e., by replacing the 3'-OH group with a protecting group.

It will be understood that references herein to '3'-block', '3'-blocking group' or '3'-protecting group' refer to the group attached to the 3' end of the nucleoside triphosphate which prevents further nucleotide addition. The present method uses reversible 3'-blocking groups which can be removed by cleavage to allow the addition of further nucleotides. By contrast, irreversible 3'-blocking groups refer to dNTPs where the 3'-OH group can neither be exposed nor uncovered by cleavage.

The 3'-blocked nucleoside 5'-triphosphate can be blocked by any chemical group that can be unmasked to reveal a 3'-OH. The 3'-blocked nucleoside triphosphate can be blocked by a 3'-O-azidomethyl, 3'-aminooxy, 3'-O—(N-oxime) (3'-O—N=CR$_1$R$_2$, where R$_1$ and R$_2$ are each a C$_1$-C$_3$ alkyl group, for example CH$_3$, such that the oxime can be O—N=C(CH$_3$)$_2$(N-acetoneoxime)), 3'-O-allyl group, 3'-O-cyanoethyl, 3'-O-acetyl, 3'-O-nitrate, 3'-phosphate, 3'-O-acetyl levulinic ester, 3'-O-tert butyl dimethyl silane, 3'-O-trimethyl(silyl)ethoxymethyl, 3'-O-ortho-nitrobenzyl, and 3'-O-para-nitrobenzyl.

The 3'-blocked nucleoside 5'-triphosphate can also be blocked by any chemical group that can be directly utilized in chemical ligations, such as copper-catalyzed or copper-free azide-alkyne click reactions and tetrazine-alkene click reactions. The 3'-blocked nucleoside triphosphate can include chemical moieties containing an azide, alkyne, alkene, and tetrazine.

References herein to 'cleaving agent' refer to a substance which is able to cleave the 3'-blocking group from the 3'-blocked nucleoside triphosphate. In one embodiment, the cleaving agent is a chemical cleaving agent. In an alternative embodiment, the cleaving agent is an enzymatic cleaving agent. The cleaving can be done in a single step, or can be a multi-step process, for example to transform an oxime (such as for example 3'-O—(N-oxime), 3'-O—N=C(CH$_3$)$_2$, into aminooxy (O—NH$_2$), followed by cleaving the aminooxy to OH.

It will be understood by the person skilled in the art that the selection of cleaving agent is dependent on the type of 3'-nucleotide blocking group used. For instance, tris(2-carboxyethyl)phosphine (TCEP) or tris(hydroxypropyl)phosphine (THPP) can be used to cleave a 3'-O-azidomethyl group, palladium complexes can be used to cleave a 3'-O-allyl group, or sodium nitrite can be used to cleave a 3'-aminooxy group. Therefore, in one embodiment, the cleaving agent is selected from: tris(2-carboxyethyl)phosphine (TCEP), a palladium complex or sodium nitrite.

In one embodiment, the cleaving agent is added in the presence of a cleavage solution comprising a denaturant, such as urea, guanidinium chloride, formamide or betaine. The addition of a denaturant has the advantage of being able to disrupt any undesirable secondary structures in the DNA. In a further embodiment, the cleavage solution comprises one or more buffers. It will be understood by the person skilled in the art that the choice of buffer is dependent on the exact cleavage chemistry and cleaving agent required.

References herein to an 'initiator oligonucleotide' or 'initiator sequence' refer to a short oligonucleotide with a free 3'-end which the 3'-blocked nucleoside triphosphate can be attached to.

In one embodiment, the initiator sequence is a DNA initiator sequence. In an alternative embodiment, the initiator sequence is an RNA initiator sequence.

References herein to a 'DNA initiator sequence' refer to a small sequence of DNA which the 3'-blocked nucleoside triphosphate can be attached to, i.e., DNA will be synthesised from the end of the DNA initiator sequence.

In one embodiment, the initiator sequence is between 5 and 50 nucleotides long, such as between 5 and 30 nucleotides long (i.e. between 10 and 30), in particular between 5 and 20 nucleotides long (i.e., approximately 20 nucleotides long), more particularly 5 to 15 nucleotides long, for example 10 to 15 nucleotides long, especially 12 nucleotides long.

In one embodiment, the initiator sequence is single-stranded. In an alternative embodiment, the initiator sequence is double-stranded. It will be understood by persons skilled in the art that a 3'-overhang (i.e., a free 3'-end) allows for efficient addition.

In one embodiment, the initiator sequence is immobilised on a solid support. This allows TdT and the cleaving agent to be removed (in steps (c) and (e), respectively) without washing away the synthesised nucleic acid. The initiator sequence may be attached to a solid support stable under aqueous conditions so that the method can be easily performed via a flow setup.

In one embodiment, the initiator sequence is immobilised on a solid support via a reversible interacting moiety, such as a chemically-cleavable linker, an antibody/immunogenic epitope, a biotin/biotin binding protein (such as avidin or streptavidin), or glutathione-GST tag. Therefore, in a further embodiment, the method additionally comprises extracting the resultant nucleic acid by removing the reversible interacting moiety in the initiator sequence, such as by incubating with proteinase K.

In one embodiment, the initiator sequence contains a base or base sequence recognisable by an enzyme. A base recognised by an enzyme, such as a glycosylase, may be removed to generate an abasic site which may be cleaved by chemical or enzymatic means. A base sequence may be recognised and cleaved by a restriction enzyme.

In a further embodiment, the initiator sequence is immobilised on a solid support via a chemically-cleavable linker, such as a disulfide, allyl, or azide-masked hemiaminal ether linker. Therefore, in one embodiment, the method additionally comprises extracting the resultant nucleic acid by cleaving the chemical linker through the addition of tris(2-carboxyethyl)phosphine (TCEP) or dithiothreitol (DTT) for a disulfide linker; palladium complexes or an allyl linker; or TCEP for an azide-masked hemiaminal ether linker.

In one embodiment, the resultant nucleic acid is extracted and amplified by polymerase chain reaction using the nucleic acid bound to the solid support as a template. The initiator sequence could therefore contain an appropriate forward primer sequence and an appropriate reverse primer could be synthesised.

In one embodiment, the terminal deoxynucleotidyl transferase (TdT) of the invention is added in the presence of an extension solution comprising one or more buffers (e.g., Tris or cacodylate), one or more salts (e.g., $Na^+$, $K^+$, $Mg^{2+}$, $Mn^{2+}$, $Cu^{2+}$, $Zn^{2+}$, $Co^{2+}$, etc. all with appropriate counterions, such as Cl) and inorganic pyrophosphatase (e.g., the *Saccharomyces cerevisiae* homolog). It will be understood that the choice of buffers and salts depends on the optimal enzyme activity and stability. The use of an inorganic pyrophosphatase helps to reduce the build-up of pyrophosphate due to nucleoside triphosphate hydrolysis by TdT. Therefore, the use of an inorganic pyrophosphatase has the advantage of reducing the rate of (1) backwards reaction and (2) TdT strand dismutation.

In one embodiment, step (b) is performed at a pH range between 5 and 10. Therefore, it will be understood that any buffer with a buffering range of pH 5-10 could be used, for example cacodylate, Tris, HEPES or Tricine, in particular cacodylate or Tris.

In one embodiment, step (d) is performed at a temperature less than 99° C., such as less than 95° C., 90° C., 85° C., 80° C., 75° C., 70° C., 65° C., 60° C., 55° C., 50° C., 45° C., 40° C., 35° C., or 30° C. It will be understood that the optimal temperature will depend on the cleavage agent utilised. The temperature used helps to assist cleavage and disrupt any secondary structures formed during nucleotide addition.

In one embodiment, steps (c) and (e) are performed by applying a wash solution. In one embodiment, the wash solution comprises the same buffers and salts as used in the extension solution described herein. This has the advantage of allowing the wash solution to be collected after step (c) and recycled as extension solution in step (b) when the method steps are repeated.

Also disclosed is a kit comprising a terminal deoxynucleotidyl transferase (TdT) as defined herein in combination with an initiator sequence and one or more 3'-blocked nucleoside triphosphates.

The invention includes the nucleic acid sequence used to express the modified terminal transferase. Included within the invention are the codon-optimized cDNA sequences which express the modified terminal transferase. Included are the codon-optimized cDNA sequences for each of the protein variants (SEQ ID NOs 4-727).

The nucleic acid sequence may be the sequence below (ID 728):

```
ATGCTGCATATTCCGATTTTCCCGCCGATTAAGAAGCGCCAGAAGCTGCC

GGAGAGCAGAAATTCCTGCAAATATGAAGTCAAGTTCTCTGAAGTTGCGA

TTTTCCTGGTTGAGCGCAAGATGGGTAGCAGCCGTCGCAAGTTTCTGACC

AACCTGGCGCGTAGCAAGGGCTTTCGTATCGAAGATGTTTTGAGCGATGC

GGTGACCCACGTTGTCGCCGAGGACAACAGCGCGGACGAGCTGTGGCAGT

GGCTCCAAAATTCCAGCCTGGGTGATCTGTCCAAAATTGAAGTCCTGGAC

ATTTCATGGTTCACCGAGTGTATGGGTGCCGGTAAACCTGTGCAAGTCGA

GGCCCGTCACTGCCTGGTCAAGAGCTGTCCGGTGATCGATCAGTACCTTG

AGCCATCCACGGTTGAAACGGTCAGCCAATATGCGTGCCAACGTCGTACG

ACCATGGAGAACCATAACCAGATTTTCACGGACGCATTTGCCATCCTGGC

GGAGAATGCTGAGTTTAACGAGAGCGAGGGTCCGTGCCTGGCGTTTATGC

GTGCAGCTAGCCTGCTGAAATCGTTGCCGCACGCAATTTCTAGCAGCAAA

GACCTGGAAGGTCTGCCGTGCCTGGGCGACCAGACGAAAGCCGTAATCGA

GGACATCTTAGAATACGGTCAGTGCAGCAAAGTTCAAGATGTGTTGTGTG

ATGACCGTTACCAGACCATCAAACTGTTCACGAGCGTTTTTGGCGTGGGC

CTGAAAACTGCAGAGAAGTGGTACCGCAAGGGTTTCCACTCTCTGGAAGA
```

-continued

```
AGTGCAAGCGGATAATGCGATCCATTTCACGAAAATGCAAAAAGCGGGCT

TCCTGTACTATGATGACATTAGCGCAGCAGTTTGTAAGGCTGAGGCCCAA

GCGATCGGTCAGATCGTCGAAGAGACTGTGCGTCTGATCGCACCGGATGC

GATTGTCACCCTGACGGGCGGTTTTCGCCGTGGTAAAGAGTGCGGTCACG

ACGTTGACTTTCTGATCACCACCCCGGAAATGGGCAAAGAAGTGTGGCTG

CTGAATCGTCTGATTAACCGTCTGCAGAATCAGGGTATTCTGTTGTATTA

TGACATTGTTGAGAGCACCTTCGACAAAACCCGTCTGCCGTGTCGCAAGT

TCGAGGCAATGGACCATTTTCAGAAGTGCTTTGCGATCATTAAGTTGAAG

AAAGAACTGGCGGCTGGCCGTGTGCAAAAAGACTGGAAAGCGATCCGTGT

TGATTTCGTGGCTCCGCCGGTCGACAATTTCGCCTTTGCATTGCTGGGTT

GGACCGGTAGCCGTCAGTTCGAGCGTGATCTGCGCCGCTTTGCGCGCCAC

GAACGTAAGATGCTGCTGGATAACCATGCACTGTACGATAAGACCAAAAA

GATTTTCCTGCCGGCCAAAACCGAAGAAGATATCTTTGCGCACCTGGGCT

TGGACTACATCGATCCATGGCAACGCAACGCGTAATGA
```

The invention includes a cell line producing the modified terminal transferase.

EXAMPLES

Expression of TdT Variants Briefly, plasmids containing genes encoding terminal transferase enzymes were transformed into BL21 E. coli competent cells. Starter Luria broth (LB) cultures were grown overnight at 37° C. and inoculated into LB expression cultures. Expression cultures were grown to an optical density of 0.6 at 600 nm and induced by the addition of IPTG to 1 mM. Cultures were induced and grown overnight at 25° C. The following morning, cultures were lysed in a detergent lysis buffer and purified to homogeneity by immobilized metal affinity chromatography (IMAC).

Assaying the Incorporation of Reversible Terminators by TdT Variants 173 terminal transferase enzymes were expressed, purified, and compared against wild-type bovine TdT (SEQ ID NO 2). Purified engineered TdTs were then used in the following assays: a fluorescently labeled 15-nt ssDNA primer was incubated with 1×TdT buffer (Thermo Fisher Scientific), yeast inorganic pyrophosphatase (Sigma-Aldrich, 0.1 mU/μl), 3'-azidomethyl dTTP or 3'-aminooxy dATP, and engineered TdT (24 μg/μl) for 10 min at 37° C. Formamide (Fisher Scientific) was then used to quench the reaction, and samples were directly loaded onto and analysed by denaturing polyacrylamide gel electrophoresis. Gels were imaged and resulting gel bands were quantified with a Typhoon scanner (GE).

The results from the 173 TdT enzymes (SEQ ID NOs 1-173) are shown in FIG. 1.

Assaying the Incorporation of Base-Modified Reversible Terminators by TdT Variants

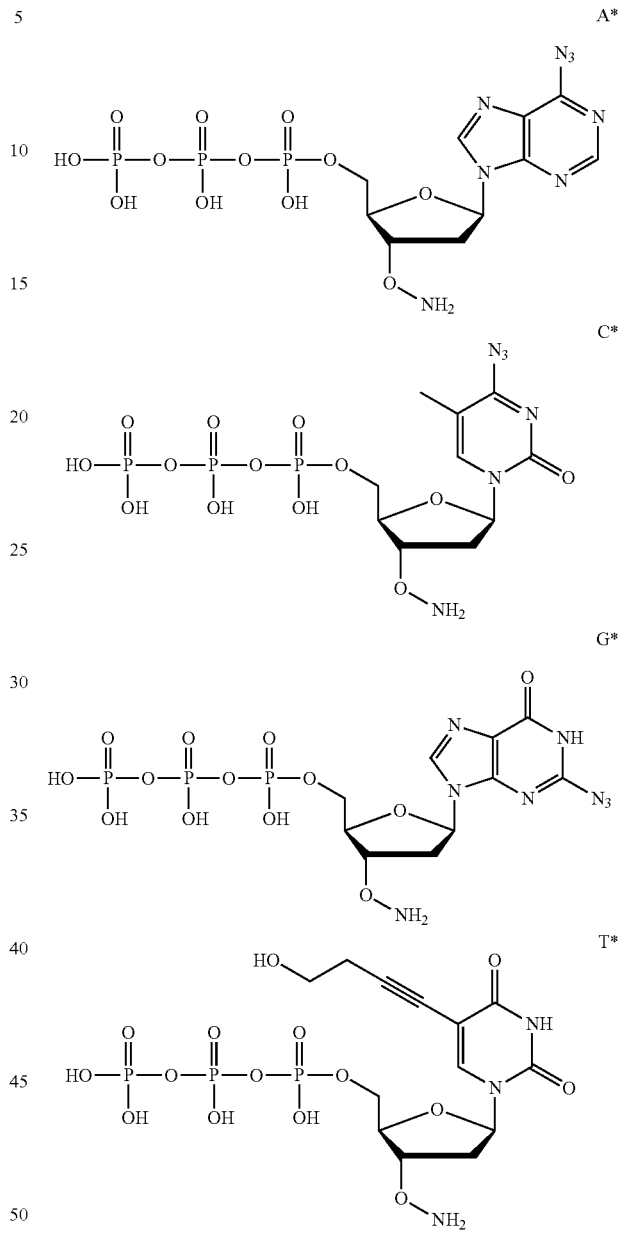

A* describes 3'-aminooxy 6-azido 2'-deoxyadenosine 5'-triphosphate;
C* describes 3'-aminooxy 4-azido 5-methyl 2'-deoxycytidine 5'-triphosphate;
G* describes 3'-aminooxy 2-azido 2'-deoxyguanosine 5'-triphosphate;
T* describes 3'-aminooxy 5-(-hydroxy-1-butynyl) 2'-deoxyuridine 5'-triphophate.

192 terminal deoxynucleotidyl transferases (TdT) variants were expressed and purified as described above. The expressed variants had SEQ ID NOs: 345, 347, 352, 357, 359, 360, 361, 362, 364, 365, 366, 367, 368, 370, 371, 372, 375, 376, 377, 378, 380, 382, 383, 384, 385, 387, 388, 392, 393, 394, 395, 397, 398, 399, 401, 405, 406, 410, 411, 416, 418, 422, 426, 427, 430, 433, 436, 439, 440, 442, 444, 445, 446, 447, 450, 453, 454, 455, 457, 460, 461, 462, 463, 464, 467, 472, 473, 475, 476, 477, 478, 479, 480, 485, 486, 487, 489, 492, 494, 495, 497, 499, 500, 503, 505, 506, 507, 509, 510, 514, 516, 517, 519, 524, 525, 526, 527, 528, 529, 531, 532, 533, 535, 543, 544, 546, 550, 553, 555, 557, 559, 560, 561, 562, 564, 565, 567, 568, 570, 572, 573, 575, 580, 582, 584, 589, 593, 595, 598, 599, 600, 601, 604, 605, 606, 609, 611, 612, 614, 618, 619, 620, 623, 629, 637, 638, 639, 641, 643, 644, 646, 648, 649, 651, 652, 654, 657, 658, 660, 661, 662, 664, 665, 666, 667, 670, 673, 678, 679, 681, 684, 685, 687, 690, 692, 698, 699, 700, 703, 706, 707, 708, 711, 712, 715, 716, 717, 718, 720, 721, 722, 725.

The base-modified reversibly terminators A*, C*, G*, and T* were supplied as substrates to engineered variants in a single nucleotide incorporation assay. A pool of DNA initiators with degenerate ends ( . . . NNN, where N=A, C, G, T) was immobilised to a solid support and exposed to nucleotide addition mixture (NAM) solutions containing (1) a TdT variant, (2) neutral pH buffer, (3) monovalent salt, (4) cobalt chloride, and (5) 3'-ONH$_2$-dXTP, where X is the modified nucleobase resulting in A*, C*, G*, or T*. The incubation temperature was 37° C. and the reaction time was 2.5 minutes. The solid support was then washed with a high salt solution at neutral pH followed by a low salt solution at neutral pH. The initiator pools transformed into sequencing libraries and analysed by next-generation sequencing (NGS) on an Illumina NextSeq500 with paired-end 30 cycle reads (PE30 reads). Bcl files were converted to fastq files with Illumina's bcl2fastq conversion software and analysed in R. The incorporation efficiency ([reads containing N+1 product]/{[reads containing N initiator]+[reads containing N+1 product]}) was calculated for the addition of each modified base against to all possible initiator contexts. The average incorporation efficiency across all contexts is presented in FIG. 3 (top panel). Wild-type bovine and spotted gar TdT activities as it relates to the single nucleotide incorporation of the base-modified reversibly terminated nucleotides A*, C*, G*, and T* are indicated by the dotted line. The dotted line occurs at y=0 due to the inability of wild-type bovine or spotted gar TdTs to incorporate these base-modified reversibly terminated nucleotides in our assay. All of the presented mutations in the TdT variants resulted in improvements in TdT modified-base incorporation relative to wild-type bovine and wild-type spotted gar TdTs.

Assaying the Multicycling Capabilities of TdT Variants

Figure 3:
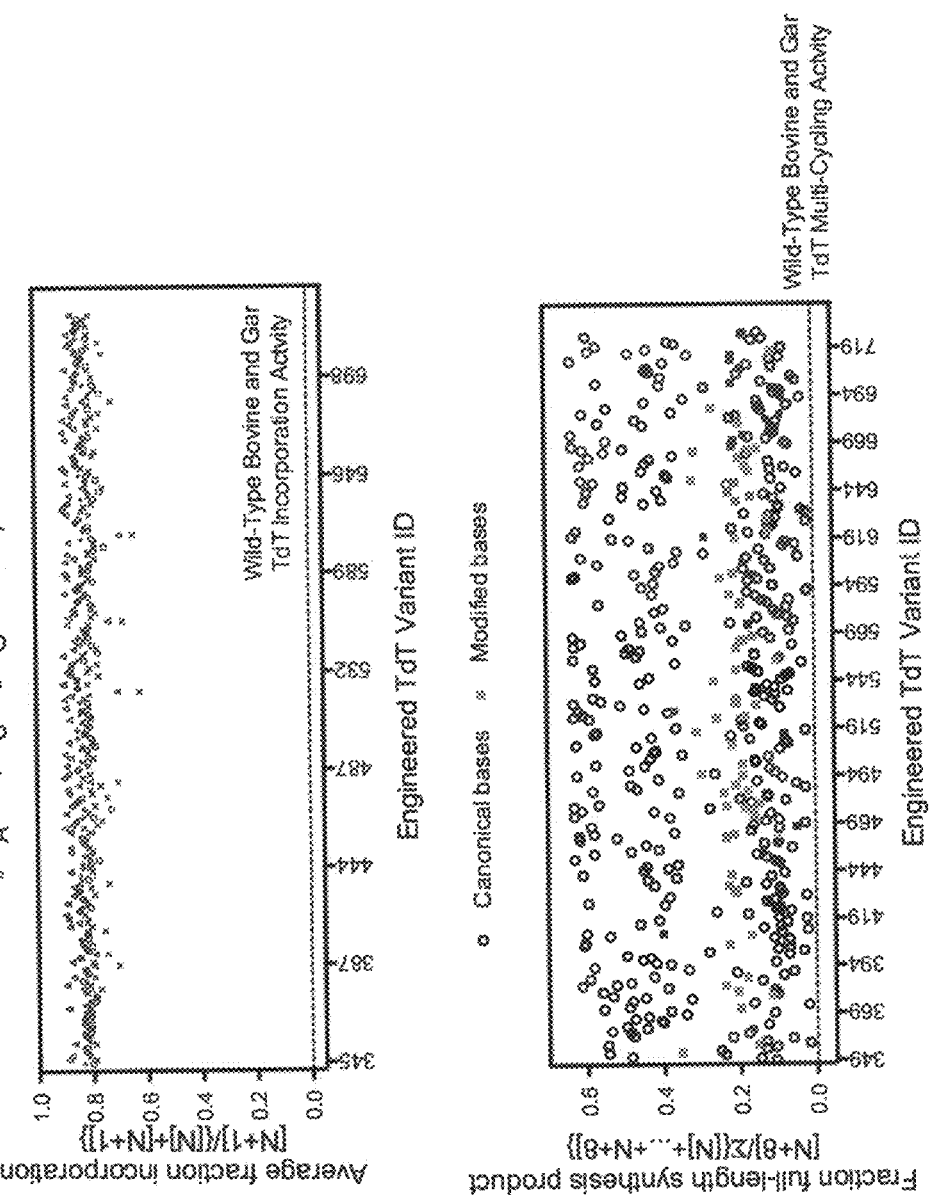
FIG. 3. Top panel: Base-modified substrates A*, C*, G*, and T* were supplied to engineered variants in a single nucleotide incorporation assay. A* describes 3'-aminooxy 6-azido 2'-deoxyadenosine 5'-triphosphate; C* describes 3'-aminooxy 4-azido 5-methyl 2'-deoxycytidine 5'-triphosphate; G* describes 3'-aminooxy 2-azido 2'-deoxyguanosine 5'-triphosphate; T* describes 3'-aminooxy 5-(-hydroxy-1-butynyl) 2'-deoxyuridine 5'-triphosphate. A pool of DNA initiators with degenerate ends was immobilised to a solid support and exposed to nucleotide addition mixture (NAM) solutions containing (1) TdT variant, (2) neutral pH buffer, (3) monovalent salt, (4) cobalt chloride, and (5) 3'-ONH$_2$-dXTP, where X is a modified nucleobase resulting in A*, C*, G*, or T*. The incubation temperature was 37° C. and the reaction time was 2.5 minutes. The solid support was then washed with a high salt solution at neutral pH followed by a low salt solution at neutral pH. The initiator pools were transformed into sequencing libraries and analysed by next-generation sequencing (NGS) on an Illumina NextSeq500 with PE30 reads. Bcl files were converted to fastq files with Illumina's bcl2fastq conversion software and analysed in R. The incorporation efficiency ([reads containing N+1 product]/{[reads containing N initiator]+[reads containing N+1 product]}) was calculated for the addition of each modified base against to all possible initiator contexts. The average incorporation efficiency across all contexts is presented in FIG. 3 (top panel). The single nucleotide incorporations by wild-type bovine and wild-type spotted gar TdT of the base-modified reversibly terminated nucleotides A*, C*, G*, and T* are indicated by the dotted line. The dotted line occurs at y=0 due to the inability of wild-type bovine or spotted gar TdTs to incorporate these base-modified reversibly terminated nucleotides in the assay. All of the presented mutations in the TdT variants resulted in improvements in TdT modified-base incorporation relative to wild-type bovine and wild-type spotted gar TdTs. Bottom panel: Solid support synthesis of an 8-nt nucleic acid sequence using 3'-ONH$_2$ nucleoside 5'-triphosphates with terminal deoxynucleotidyl transferase (TdT) SEQ ID NOs 1 & 344-727. The DNA sequence 5'-ATCGATCG-3' was synthesized by repeated exposure of a solid support bound DNA initiator to nucleotide addition mixture (NAM) solutions containing (1) TdT, (2) neutral pH buffer, (3) monovalent salt, (4) cobalt chloride, and (5) 3'-ONH$_2$-dNTP, where N is selected from adenine, thymine, cytosine, or guanine. A cycle consists of the following: (A) NAM solution with a specified A, T, C, or G reversibly terminated nucleotide was incubated for 5 minutes on the solid support at 37 C; (B) the solid support was then washed with a high salt solution at neutral pH; (C) the solid support was then exposed to acidic aqueous sodium nitrite; and (D) the solid support was then washed with the same high salt solution at neutral pH from (B). (A)-(D) were then repeated 7 more times to synthesize the desired 8-nt sequence. Synthesized DNA were analysed by running reactions on a denaturing polyacrylamide gel and quantified by virtue of a fluorophore covalently attached to the DNA initiator. The fraction full length (8-nt species) was determined by taking fluorescence intensity of the 8-nt band and dividing by total lane intensity. Wild-type bovine and spotted gar TdT activities as it relates to fraction full-length are indicated by the dotted line. All mutations included in the TdT variants resulted in improvements in TdT relative to wild-type bovine and spotted gar TdTs.
Figure 4:
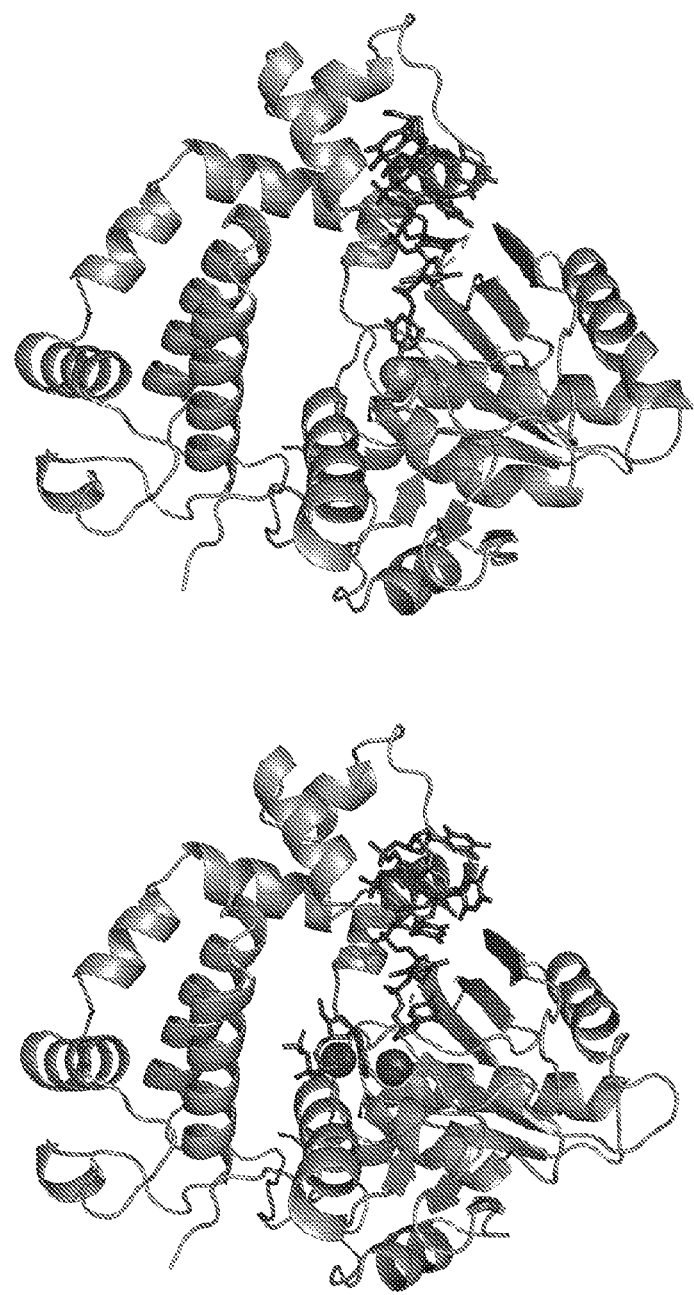
FIG. 4. Spotted gar TdT homology structure based on the co-crystal structure of a preferred engineered Nuclera TdT variant bound to a DNA initiator and a reversibly terminated dNTP. An engineered TdT variant with a BRCT-domain truncation was expressed in *Escherichia coli* and purified through immobilized metal affinity chromatography followed by size exclusion chromatography. The aforementioned TdT (60 micromolar) was then co-crystallized by sitting drop vapor diffusion at 19° C. with a DNA oligonucleotide (5'-TTTTT[ddC]-3'; 120 micromolar), cobalt chloride (1 mM), in the absence (top) or presence (bottom) of dATP-ONH$_2$ (1 mM) in the following reservoir solutions: Bis-Tris HCl (100 mM), NaCl (27 mM), 22% w/v PEG 3350 or Bis-Tris HCl (10 mM) and 27.5% w/v PEG MME 500, respectively. Plate-like crystals appeared and grew to maximum dimensions of 400×50×5 μm$^3$ over 1 week and diffracted to 2.6 and 2.5 angstroms, respectively, with a space group of P2$_1$2$_1$2$_1$ and unit cell dimensions of a=56.5 Å, b=80.0 Å, c=88.2 Å. and a=55.6 Å, b=79.1 Å, c=88.6 Å, respectively. Data were indexed, integrated, and scaled using the automatic software pipeline at the Diamond Light Source. Molecular replacement with a homology model of *Lepisosteus oculatus* (spotted gar) followed by cycles of manual model building interspersed with rigid-body, simulated annealing, energy minimization and individual isotropic D-factor produced complete structural models ($R_{free}$=27.8% and 28.6%, respectively). Cobalt ions were identified by virtue of their anomalous scattering. The spotted gar TdT wild-type sequence (>95% sequence identity) with a BRCT-domain truncation was modelled onto the two structures.

Solid support synthesis of an 8-nt nucleic acid sequence using 3'-ONH$_2$ nucleoside 5'-triphosphates with terminal deoxynucleotidyl transferase (TdT) SEQ ID NOs 1 & 344-727. The TdT variants were expressed and purified as described above. The DNA sequence 5'-ATCGATCG-3' was synthesized by repeated exposure of a solid support bound DNA initiator to nucleotide addition mixture (NAM) solutions containing (1) TdT, (2) neutral pH buffer, (3) monovalent salt, (4) cobalt chloride, and (5) 3'-ONH$_2$-dNTP, where N is selected from adenine, thymine, cytosine, or guanine. A cycle consists of the following: (A) NAM solution with a specified A, T, C, or G reversibly terminated nucleotide were incubated for 5 minutes on the solid support at 37° C.; (B) the solid support was then washed with a high salt solution at neutral pH; (C) the solid support was then exposed to acidic aqueous sodium nitrite; and (D) the solid support was then washed with the same high salt solution at neutral pH from (B). (A)-(D) were then repeated 7 more times to synthesize the desired 8-nt sequence. Synthesized DNA were analysed by running reactions on a denaturing polyacrylamide gel and quantified by virtue of a fluorophore covalently attached to the DNA initiator. The fraction full length (8-nt species) was determined by taking fluorescence intensity of the 8-nt band and dividing by total lane intensity. Wild-type bovine and spotted gar TdT activities as it relates to fraction full-length are indicated by the dotted line at y=0 indicating that they are incapable of synthesizing any 8-nt product. All mutations included in the TdT variants resulted in improvements in TdT relative to wild-type bovine and spotted gar TdTs. Results are shown in FIG. 3 (bottom panel).

SEQUENCE LISTING (862 sequences)

SEQ ID NO: 1 - protein, 494 aa, Lepisosteus oculatus
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFMRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEAQAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIDPWQRNA

SEQ ID NO: 2 - protein, 509 aa, Bos taurus
MDPLCTASSGPRKKRPRQVGASMASPPHDIKFQNLVLFILEKKMGTTRRNFLMELARRKGFRVENELSDSVTHIVAENNSGSEVLEWLQVQNIRASSQLELLDVSWLIESMGAGKPVEITGKHQLVVRTDYSATPNPGFQKTPPLAVKKISQYACQRKTTLNNYNHIFTDAFEILAENSEFKENEVSYVTFMRAASVLKSLPFTIISMKDTEGIPCLGDKVKCIIEEIIEDGESSEVKAVLNDERYQSFKLFTSVFGVGLKTSEKWFRMGFRSLSKIMSDKTLKFTKMQKAGFLYYEDLVSCVTRAEAEAVGVLVKEAVWAFLPDAFVTMTGGFRRGKKIGHDVDFLITSPGSAEDEEQLLPKVINLWEKKGLLLYYDLVESTFEKFKLPSRQVDTLDHFQKCFLILKLHHQRVDSSKSNQQEGKTWKAIRVDLVMCPYENRAFALLGWTGSRQFERDIRRYATHERKMMLDNHALYDKTKRVFLKAESEEEIFAHLGLDYIEPWERNA

SEQ ID NO: 3 - protein, 530 aa, Mus musculus
MDPLQAVHLGPRKKRPRQLGTPVASTPYDIRFRDLVLFILEKKMGTTRRAFLMELARRKGFRVENELSDSVTHIVAENNSGSDVLEWLQLQNIKASSELELLDISWLIECMGAGKPVEMMGRHQLVVNRNSSPSPVPGSQNVPAPAVKKISQYACQRRTTLNNYNQLFTDALDILAENDELRENEGSCLAFMRASSVLKSLPFPITSMKDTEGIPCLGDKVKSIIEGIIEDGESSEAKAVLNDERYKSFKLFTSVFGVGLKTAEKWFRMGFRTLSKIQSDKSLRFTQMQKAGFLYYEDLVSCVNRPEAEAVSMLVKEAVVTFLPDALVTMTGGFRRGKMTGHDVDFLITSPEATEDEEQQLLHKVTDFWKQQGLLLYCDILESTFEKFKQPSRKVDALDHFQKCFLILKLDHGRVHSEKSGQQEGKGWKAIRVDLVMCPYDRRAFALLGWTGSRQFERDLRRYATHERKMMLDNHALYDRTKGKTVTISPLDGKVSKLQKALRVFLEAESEEEIFAHLGLDYIEPWERNA

SEQ ID NO: 4 - protein, 494 aa, Artificial Sequence
  Modified TdT Sequences
MLHIPIFPPIKKRQKLPESRNSCKYEVKFSELAIFLVERKMGSSRRKFLTNLARSKGFRIEDVLSDAITHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEDPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 5 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVEVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEAQAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRWARHERKMLLDNHALYDKTKKIFLPAKTEEDIFAHLGLDYIPPWQRNA

SEQ ID NO: 6 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHTLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVVCPVDNFAFALLGWTGSRQFERDLRRFARHERKMLLDNHALYDKTKKIFLPAKTEEDIFAHLGLDYIPPWQRNA

SEQ ID NO: 7 - protein, 494 aa, Artificial Sequence
  Modified TdT Sequences
MLHIPIFPPIKKRQKLPESRNSCKYEVKFSELAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSPYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQRAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 8 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIQDILEYGQCSKVQDVLCDDRYQTIKLFTSVFGVGLKTAEKWYRKGFHSLEEVQADNSIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMILDNHALYDKTKKIFLPAKTEEDIFAHLGLDYIPPWQRNA

SEQ ID NO: 9 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHIVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHEKKMLLDNHALYDKTKKIFLPAKTEEDIFAHLGLDYIPPWQRNA

SEQ ID NO: 10 - protein, 494 aa, Artificial Sequence
  Modified TdT Sequences
MLHIPIFPPIKKRQKLPESRNSCKYEVKFSEIAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKNWKAIRVDFVMCPVDNFAFALLGWTGSRQFERDLRRFARHERKMLLDNHALYDKTKKIFLPAKTEEDIFAHLGLDYIPPWQRNA

SEQ ID NO: 11 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQIEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNTIHFTKMQKAGFLYYDDISAAVCKAEAQAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 12 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEQNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEAQAIGQIVEETVRLIAPDAIVTLTGGFRRGKNCGHDVDFLITTPEMGKEVWLLNRLINRLQNQGILLYYDIVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 13 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNKIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGLHSLEEVQADNTIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 14 - protein, 494 aa, Artificial Sequence
  Modified TdT Sequences
MLHIPIFPPIKKRQKLPESRNSCKYEVKFSEVVIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSAVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQRAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 15 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHIVAEDNSADELWQWLQNSSLGDLSKIEVLDISWFTECMGAGKPVQVEARHCLVKSCPVIDQYLEPSTVETVSQYACQRRTTMEHHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITSPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 16 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAVLAENAEFNESEGPCLAFRRAASLLKSLPHAISSSKDLEGLPCLGDQTKAVIQDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIDPWQRNA

SEQ ID NO: 17 - protein, 494 aa, Artificial Sequence
  Modified TdT Sequences
MLHIPIFPPIKKRQKLPESRNSCKYEVKFSEVAIFLVERKMGSSRRAFLTNLARSKGFRIEDVLSDAVTHVVAEQNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVVPPVDNFAFALLGWTGSRQFERDLRRFARHERKMILDNHALYDKTKKIFLPAKTEEDIFAHLGLDYIPPWQRNA

SEQ ID NO: 18 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEQNSADELWQWLQNSSLGDLSKIEVLDISWFTECMEAGKPVQVEARHCLVKSCPVIDQYLEPSTVETVSQYACQRRTTMENCNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKNWKAIRVDFVMPPVDNFAFALLGWTGSRQFERDLRRFARHERKMLLDNHALYDKTKKIFLPAKTEEDIFAHLGLDYIPPWQRNA

SEQ ID NO: 19 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQIEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCRAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKERAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 20 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEQNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNKGLLLYYDIVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 21 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIAVLDISWFTECMGAGKPVQVEARHCLVKSCPVIDQYLEPSTVETVSQYACQRRTTMENHNKIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAAPVDNFAFALLGWTGSRQFERDLRRFARHERKMLLDNHALYDKTKKIFLPAKTEEDIFAHLGLDYIPPWQRNA

SEQ ID NO: 22 - protein, 494 aa, Artificial Sequence
  Modified TdT Sequences
MLHIPIFPPIKKRQKLPESRNSCKYEVKFSEVAIFLVERKMGSSRRAFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIQDILEYGQCSKVQDVLCDDRYQTIKLFTSVFGVGLKTAEKWYRKGFHSLEEVQADNTIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 23 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAITHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKERAAGRVQKNWKAIRVDFVMPPVDNFAFALLGWTGSRQFERDLRRFARHERKMLLDNHALYDKTKKIFLPAKTEEDIFAHLGLDYIPPWQRNA

SEQ ID NO: 24 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEQNSADELWQWLQNSSLGDLSKIEVLDISWFTECMRAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMCPVDNFAFALLGWTGSRQFERDLRRFARHERKMLLDNHALYDKTKKIFLPAKTEEDIFAHLGLDYIPPWQRNA

SEQ ID NO: 25 - protein, 494 aa, Artificial Sequence
  Modified TdT Sequences
MLHIPIFPPIKKRQKLPESRNSCKYEVKFSEVAIFLVERKMGASRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVKADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVVPPVDNFAFALLGWTGSRQFERDLRRFARHERKMLLDNHALYDKTKKIFLPAKTEEDIFAHLGLDYIPPWQRNA

SEQ ID NO: 26 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQSEARHCLVKSCPVIDQYLEPSTVETVSQYACQRRTTMEHHNQIFTDAFAILAENAEFNESEGPCLAFRRAASLLKSLPHAISSSKDLEGLPCLGDQTKRVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 27 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEDPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQRAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVACPVDNFAFALLGWTGSRQFERDLRRFARHERKMLLDNHALYDKTKKIFLPAKTEEDIFAHLGLDYIPPWQRNA

SEQ ID NO: 28 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIQDILEYGQCSKVQDVLCDDRYQTIKLFTSVFGVGLKTAEKWYRKGFHSLEEVKADNAIHFTKMQKAGFLYYDDISAAVCKAEADAIGQIVEETVRLIAPDAIVTLTGGFRRGKECGHDVDFLITTPEMGKEVWLLNRLINRLQNQGILLYCDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 29 - protein, 494 aa, Artificial Sequence
  Modified TdT Sequences
MLHIPIFPPIKKRQKLPESRNSCKYEVKFSEVAIFLVERKMGSSRRKFLTNLGRSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNKIFTDAFAILAENAEFNESEGPCLAFRRAASLLKSLPHAISSSKDLEGLPCLGDQTKAVIQDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 30 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEQNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVACPVDRFAFALLGWTGSRQFERDLRRFARHERKMLLDNHALYDKTKKIFLPAKTEEDIFAHLGLDYIPPWQRNA

SEQ ID NO: 31 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKNWKAIRVDFVLCPVDNFAFALLGWTGSRQFERDLRRFARHERKMLLDNHALYDKTKKIFLPAKTEEDIFAHLGLDYIPPWQRNA

SEQ ID NO: 32 - protein, 494 aa, Artificial Sequence
  Modified TdT Sequences
MLHIPIFPPIKKRQKLPESRNSCKYEVKFSEVAIFLVERKMGSSRRAFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAVLAENAEFNESEGPCLAFRRAASLLKSLPHPISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAAPVDNFAFALLGWTGSRQFERDLRRFARHERKMLLDNHALYDKTKKIFLPAKTEEDIFAHLGLDYIPPWQRNA

SEQ ID NO: 33 - protein, 494 aa, Artificial Sequence
  Modified TdT Sequences
MLHIPIFPPIKKRQKLPESRNSCKYEVKFSEVAIFLVERKMGASRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDINAAVCKAEADAIGQIVEETVRLIAPDAIVTLTGGFRRGKECGHDVDFLITTPQMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 34 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHTLEEVQADNAIHFTKMQKAGFLYYDDISAAVCKAEADAIGQIVEEAVRLIAPDAIVTLTGGFRRGKECGHDVDFLITSPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 35 - protein, 494 aa, Artificial Sequence
  Modified TdT Sequences
MLHIPIFPPIKKRQKLPESRNSCKYEVKFSEVVIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEDPCLAFRRAASLLKSLPHAISSSRDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 36 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAENNSADELWQWLQNSSLGDLSKIEVLDISWFTECMGAGKPVQVEARHCLVKSCPVIDQYLEPSTVETVSQYACQRRTTMEHHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPQMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 37 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLRDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMRKEVWLLNRLINRLQNQGILLYYDIVESTFDKTRLPCRKFEAMDHFQKCFAIIKLKKELAAGRVQKDWKAIRVDFVAAPVDNFAFALLGWTGSRQFERDLRRFARHERKMLLDNHALYDKTKKIFLPAKTEEDIFAHLGLDYIPPWQRNA

SEQ ID NO: 38 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCVAFRRAASLLKSLPHAISSSKDLEGLPCLGDQSKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAARRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 39 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEQNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVLAPVDNFAFALLGWTGSRQFERDLRRFARHERKMLLDNHALYDKTKKIFLPAKTEEDIFAHLGLDYIPPWQRNA

SEQ ID NO: 40 - protein, 494 aa, Artificial Sequence
  Modified TdT Sequences
MLHIPIFPPIKKRQKLPESRNSCKYEVKFSEIAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSAVETVSQYACQRRTTMENHNQIFTDAFAILAENAEFNESEGPCLEFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 41 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMRAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLQRLINRLQNKGILLYYDIVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 42 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHIVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKRVIEDILEYGQCSKVQDVLCDDRYQTIKLFTSVFGVGLKTAEKWYRKGFHSLEEVQADNAIHFTKMQRAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 43 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQMFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEAQAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMCPVDNFAFALLGWTGSRQFERDLRRFARHERKMLLDNHALYDKTKKIFLPAKTEEDIFAHLGLDYIPPWQRNA

SEQ ID NO: 44 - protein, 494 aa, Artificial Sequence
  Modified TdT Sequences
MLHIPIFPPIKKRQKLPESRNSCKYEVKFSEVAIFLVERKMGASRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGLHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHEKKMLLDNHALYDKTKKIFLPAKTEEDIFAHLGLDYIPPWQRNA

SEQ ID NO: 45 - protein, 494 aa, Artificial Sequence
  Modified TdT Sequences
MLHIPIFPPIKKRQKLPESRNSCKYEVKFSEVAIFLVERKMGSSRRKFLTNLARSKGFRIENVLSDAVTHVVAEQNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQSKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 46 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHPISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEAQAIGQIVEETVRLIAPDAIVTLTGGFRRGKECGHDVDFLITTPEMGKEVWLLNRLINRLQNQGILLYCDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 47 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 48 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMRAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVLPPVDRFAFALLGWTGSRQFERDLRRFARHERKMLLDNHALYDKTKKIFLPAKTEEDIFAHLGLDYIPPWQRNA

SEQ ID NO: 49 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDVSWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMCPVDNFAFALLGWTGSRQFERDLRRFARHERKMLLDNHALYDKTKKIFLPAKTEEDIFAHLGLDYIPPWQRNA

SEQ ID NO: 50 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEQNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQSIKLFTSVFGVGLKTAEKWYRKGFHSLEEVQADNAIHFTKMQKAGFLYYDDISAAVCKAEAQAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 51 - protein, 494 aa, Artificial Sequence
  Modified TdT Sequences
MLHIPIFPPIKKRQKLPESRNSCKYEVKFSEVAIFLVERKMGASRRKFLTNLGRSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITSPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 52 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLRDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQSKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMCPVDNFAFALLGWTGSRQFERDLRRFARHERKMLLDNHALYDKTKKIFLPAKTEEDIFAHLGLDYIPPWQRNA

SEQ ID NO: 53 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHPISSSKDLEGLPCLGDQSKAVIEDILEYGQCSKVQDVLCDDRYQTIKLFTSVFGVGLKTAEKWYRKGLHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 54 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFMRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEAQAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHEKKMLLDNHALYDKTKKIFLPAKTEEDIFAHLGLDYIPPWQRNA

SEQ ID NO: 55 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDVSWFTECMEAGKPVQVEARHCLVKSCPVIDQYLEPSTVETVSQYACQRRTTMENHNRIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMAPVDNFAFALLGWTGSRQFERDLRRFARHERKMLLDNHALYDKTKKIFLPAKTEEDIFAHLGLDYIPPWQRNA

SEQ ID NO: 56 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLEFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAAPVDNFAFALLGWTGSRQFERDLRRFARHERKMLLDNHALYDKTKKIFLPAKTEEDIFAHLGLDYIPPWQRNA

SEQ ID NO: 57 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQSKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNKGILLYYDIVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 58 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIAVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTSAVIEDILEYGQCSKVQDVLCDDRYQTIKLFTSVFGVGLKTAEKWYRKGFHTLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 59 - protein, 494 aa, Artificial Sequence
  Modified TdT Sequences
MLHIPIFPPIKKRQKLPESRNSCKYEVKFSEVAIFLVERKMGSSRRAFLTNLARSKGFRIEDVLSDAVTHVVAENNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNSIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 60 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 61 - protein, 494 aa, Artificial Sequence
  Modified TdT Sequences
MLHIPIFPPIKKRQKLPESRNSCKYEVKFSEVAIFLVERKMGSTRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQKQGILLYYDIVESTFDKTRLPCRKFEAMDHFQKCFAIIKLKKELAAGRVQKDWKAIRVDFVMPPVDNFAFALLGWTGSKQFERDLRRFARHERKMLLDNHALYDKTKKIFLPAKTEEDIFAHLGLDYIPPWQRNA

SEQ ID NO: 62 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEQNSADELWQWLQNSSLGDLSKIEVLDISWFTECMEAGKPVQVEARHCLVKRCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMCPVDNFAFALLGWTGSRQFERDLRRFARHERKMLLDNHALYDKTKKIFLPAKTEEDIFAHLGLDYIPPWQRNA

SEQ ID NO: 63 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAENNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNTIHFTKMQKAGFLYYDDISAAVCKAEADAIGQIVEEAVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 64 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEDPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLQRLINRLQNQGILLYYDIVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 65 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSPYACQRRTTMENHNQIFTDAFAILAENAEFNESEGPCLAFRRAASLLKSLPHAISSSRDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEAQAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 66 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENCNQIFTDAFAILAENAEFNESEGPCLAFRRAASLLKSLPHAISSSKDLEGLPCLGDQSKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMAPVDNFAFALLGWTGSRQFERDLRRFARHERKMLLDNHALYDKTKKIFLPAKTEEDIFAHLGLDYIPPWQRNA

SEQ ID NO: 67 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQIEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPQMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHEKKMLLDNHALYDKTKKIFLPAKTEEDIFAHLGLDYIPPWQRNA

SEQ ID NO: 68 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQSKAVIEDILEYGQCSKVQDVLCDDRYQTIKLFTSVFGVGLKTAEKWYRKGFHSLEEVQADNAIHFTKMQRAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVVPPVDNFAFALLGWTGSRQFERDLRRFARHERKMLLDNHALYDKTKKIFLPAKTEEDIFAHLGLDYIPPWQRNA

SEQ ID NO: 69 - protein, 494 aa, Artificial Sequence
  Modified TdT Sequences
MLHIPIFPPIKKRQKLPESRNSCKYEVKFSEVAIFLVERKMGSSRRKFLTNLGRSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFMRAASLLKSLPHPISSSKDLEGLPCLGDQTSAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 70 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQIEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQRAGFLYYDDISAAVCKAEADAIGQIVEETVRLIAPDAIVTLTGGFRRGKECGHDVDFLITTPEMRKEVWLLNRLINRLQNQGILLYYDIVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 71 - protein, 494 aa, Artificial Sequence
  Modified TdT Sequences
MLHIPIFPPIKKRQKLPESRNSCKYEVKFSELAIFLVERKMGSSRRKFLTNLARSKGFRIEDVLSDAVTHVVAEDNSADELWQWLQNSSLGDLSKIEVLDVSWFTECMEAGKPVQVEARHCLVKSCPVIDQYLEPSTVETVSQYACQRRTTMENHNQMFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 72 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVVAPVDNFAFALLGWTGSRQFERDLRRWARHERKMLLDNHALYDKTKKIFLPAKTEEDIFAHLGLDYIPPWQRNA

SEQ ID NO: 73 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENCNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEAQAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVACPVDNFAFALLGWTGSRQFERDLRRFARHERKMLLDNHALYDKTKKIFLPAKTEEDIFAHLGLDYIPPWQRNA

SEQ ID NO: 74 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEQNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLEFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMRKEVWLLNRLINRLQNQGILLYYDIVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 75 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEQNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVWLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVACPVDNFAFALLGWTGSRQFERDLRRFARHERKMLLDNHALYDKTKKIFLPAKTEEDIFAHLGLDYIPPWQRNA

SEQ ID NO: 76 - protein, 494 aa, Artificial Sequence
  Modified TdT Sequences
MLHIPIFPPIKKRQKLPESRNSCKYEVKFSEVAIFLVERKMGASRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTSAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMILDNHALYDKTKKIFLPAKTEEDIFAHLGLDYIPPWQRNA

SEQ ID NO: 77 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQSKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVWLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMCPVDNFAFALLGWTGSRQFERDLRRFARHERKMLLDNHALYDKTKKIFLPAKTEEDIFAHLGLDYIPPWQRNA

SEQ ID NO: 78 - protein, 494 aa, Artificial Sequence
  Modified TdT Sequences
MLHIPIFPPIKKRQKLPESRNSCKYEVKFREVAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKRVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 79 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAVLAENAEFNESEGPCLAFRRAASLLKSLPHAISSSKDLEGLPCLGDQSKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRWARHERKMLLDNHALYDKTKKIFLPAKTEEDIFAHLGLDYIPPWQRNA

SEQ ID NO: 80 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNKIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEAQAIGQIVEETVRLIAPDAIVTLTGGFRRGKECGHDVDFLITTPEMGKEVWLLNRLINRLQNQGILLYYDIVESTFDKTRLPCRKFEAMDAFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 81 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEEAVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIDPWQRNA

SEQ ID NO: 82 - protein, 494 aa, Artificial Sequence
  Modified TdT Sequences
MLHIPIFPPIKKRQKLPESRNSCKYEVKFSEVAIFLVERKMGSTRRKFLTNLARSKGFRIEDVLSDAVTHVVAEQNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQRAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 83 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHPISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMILDNHALYDKTKKIFLPAKTEEDIFAHLGLDYIPPWQRNA

SEQ ID NO: 84 - protein, 494 aa, Artificial Sequence
  Modified TdT Sequences
MLHIPIFPPIKKRQKLPESRNSCKYEVKFREVAIFLVERKMGSSRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFMRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITSPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 85 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCVAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMCPVDNFAFALLGWTGSRQFERDLRRFARHERKMLLDNHALYDKTKKIFLPAKTEEDIFAHLGLDYIPPWQRNA

SEQ ID NO: 86 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYCDIVESTFDKTRLPCRKFEAMDHFQKCFAIIKLKKELAAGRVQKDWKAIRVDFVACPYDNFAFALLGWTGSRQFERDLRRFARHERKMLLDNHALYDKTKKIFLPAKTEEDIFAHLGLDYIPPWQRNA

SEQ ID NO: 87 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFMRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEEAVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVVPPVDNFAFALLGWTGSRQFERDLRRFARHERKMLLDNHALYDKTKKIFLPAKTEEDIFAHLGLDYIPPWQRNA

SEQ ID NO: 88 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKNCGHDVDFLITTPEMGKEVWLLNRLINRLQNQGILLYYDIVESTFDKTRLPCRKFEAMDHFQKCFAIIKLKKELAAGRVQKDWKAIRVDFVLCPVDNFAFALLGWTGSRQFERDLRRFARHERKMLLDNHALYDKTKKIFLPAKTEEDIFAHLGLDYIPPWQRNA

SEQ ID NO: 89 - protein, 494 aa, Artificial Sequence
  Modified TdT Sequences
MLHIPIFPPIKKRQKLPESRNSCKYEVKFSELAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVACPVDRFAFALLGWTGSRQFERDLRRFARHERKMLLDNHALYDKTKKIFLPAKTEEDIFAHLGLDYIPPWQRNA

SEQ ID NO: 90 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGRPVQSEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEAQAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 91 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMEHHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHTLEEVQADNSIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 92 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGRPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGLHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAAPVDNFAFALLGWTGSRQFERDLRRFARHERKMLLDNHALYDKTKKIFLPAKTEEDIFAHLGLDYIPPWQRNA

SEQ ID NO: 93 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNKIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVVPPVDNFAFALLGWTGSRQFERDLRRFARHEKKMLLDNHALYDKTKKIFLPAKTEEDIFAHLGLDYIPPWQRNA

SEQ ID NO: 94 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQMFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMRKEVWLLNRLINRLQNQGILLYYDIVESTFDKTRLPCRKFEAMDHFQKCFAIIKLKKELAAGRVQKDWKAIRVDFVLCPVDNFAFALLGWTGSRQFERDLRRFARHERKMLLDNHALYDKTKKIFLPAKTEEDIFAHLGLDYIPPWQRNA

SEQ ID NO: 95 - protein, 494 aa, Artificial Sequence
  Modified TdT Sequences
MLHIPIFPPIKKRQKLPESRNSCKYEVKFREVAIFLVERKMGSSRRKFLTNLARSKGFRIEDVLSDAVTHVVAENNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHTLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIDPWQRNA

SEQ ID NO: 96 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAENNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQSKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 97 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEAQAIGQIVEETVWLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMPPVDNFAFALLGWTGSKQFERDLRRFARHERKMLLDNHALYDKTKKIFLPAKTEEDIFAHLGLDYIPPWQRNA

SEQ ID NO: 98 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAENNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFMRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDINAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 99 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVEVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGLHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 100 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQRAGFLYYDDISAAVCRAEAQAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 101 - protein, 494 aa, Artificial Sequence
  Modified TdT Sequences
MLHIPIFPPIKKRQKLPESRNSCKYEVKFSEVAIFLVERKMGSTRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLQRLINRLQNQGILLYYDIVESTFDKTRLPCRKFEAMDHFQKCFAIIKLKKELAAGRVQKDWKAIRVDFVACPVDNFAFALLGWTGSRQFERDLRRFARHERKMLLDNHALYDKTKKIFLPAKTEEDIFAHLGLDYIPPWQRNA

SEQ ID NO: 102 - protein, 494 aa, Artificial Sequence
  Modified TdT Sequences
MLHIPIFPPIKKRQKLPESRNSCKYEVKFSEVAIFLVERKMGSSRRKFLTNLARSKGFRIENVLSDAVTHVVAEQNSADELWQWLQNSSLGDLSKIEVLDISWFTECMEAGKPVQVEARHCLVKSCPVIDQYLEPSTVETVSQYACQRRTTMENHNQMFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 103 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEAQAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVACPVDNFAFALLGWTGSRQFERDLRRFARHERKMLLDNHALYDKTKKIFLPAKTEEDIFAHLGLDYIPPWQRNA

SEQ ID NO: 104 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAVLAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVKADNTIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 105 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQSIKLFTSVFGVGLKTAEKWYRKGLHSLEEVQADNAIHFTKMQKAGFLYYDDINAAVCKAEADAIGQIVEETVRLIAPDAIVTLTGGFRRGKECGHDVDFLITTPEMGKEVWLLNRLINRLQNQGILLYCDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 106 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEQNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDAFQKCFAIIKLKKELAAGRVQKDWKAIRVDFVAPPYDNFAFALLGWTGSRQFERDLRRFARHERKMLLDNHALYDKTKKIFLPAKTEEDIFAHLGLDYIPPWQRNA

SEQ ID NO: 107 - protein, 494 aa, Artificial Sequence
  Modified TdT Sequences
MLHIPIFPPIKKRQKLPESRNSCKYEVKFSEIAIFLVERKMGSSRRKFLTNLARSKGFRIEDVLSDAVTHVVAEDNSADELWQWLQNSSLGDLSKIEVLDISWFTECMEAGKPVQIEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMAPVDNFAFALLGWTGSRQFERDLRRFARHERKMLLDNHALYDKTKKIFLPAKTEEDIFAHLGLDYIPPWQRNA

SEQ ID NO: 108 - protein, 494 aa, Artificial Sequence
  Modified TdT Sequences
MLHIPIFPPIKKRQKLPESRNSCKYEVKFSEVAIFLVERKMGSTRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGLLLYYDIVESTFDKTRLPCRKFEAMDHFQKCFAIIKLKKELAAGRVQKDWKAIRVDFVMPPVDRFAFALLGWTGSRQFERDLRRFARHERKMLLDNHALYDKTKKIFLPAKTEEDIFAHLGLDYIPPWQRNA

SEQ ID NO: 109 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAENNSADELWQWLQNSSLGDLSKIEVLDISWFTECMGAGKPVQSEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIQDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 110 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDVSWFTECMEAGKPVQIEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEAQAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 111 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQSEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGLHSLEEVQADNAIHFTKMQKAGFLYYDDISAAVCKAEADAIGQIVEETVRLIAPDAIVTLTGGFRRGKECGHDVDFLITSPEMGKEVWLLNRLINRLQNQGILLYYDIVESTFDKTRLPCRKFEAMDAFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 112 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQKQGILLYYDIVESTFDKTRLPCRKFEAMDHFQKCFAIIKLKKELAARRVQKDWKAIRVDFVACPVDNFAFALLGWTGSRQFERDLRRFARHERKMLLDNHALYDKTKKIFLPAKTEEDIFAHLGLDYIPPWQRNA

SEQ ID NO: 113 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVEVEARHCLVKSCPVIDQYLEPSTVETVSQYACQRRTTMENHNQIFTDAFAILAENAEFNESEGPCLAFRRAASLLKSLPHAISSSKDLEGLPCLGDQSKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYCDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 114 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEQNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQSKAVIEDILEYGQCSKVQDVLCDDRYQTIKLFTSVFGVGLKTAEKWYRKGFHSLEEVQADKAIHFTKMQKAGFLYYDDISAAVCRAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 115 - protein, 494 aa, Artificial Sequence
  Modified TdT Sequences
MLHIPIFPPIKKRQKLPESRNSCKYEVKFREVAIFLVERKMGSSRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNKIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 116 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGLLLYYDIVESTFDKTRLPCRKFEAMDHFQKCFAIIKLKKERAAGRVQKDWKAIRVDFVMCPVDNFAFALLGWTGSRQFERDLRRFARHERKMLLDNHALYDKTKKIFLPAKTEEDIFAHLGLDYIPPWQRNA

SEQ ID NO: 117 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMRAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVWLIAPDAIVTLTGGFRRGKECGHDVDFLITTPEMGKEVWLLNRLINRLQNQGILLYYDIVESTFDKTRLPCRKFEAMDHFQKCFAIIKLKKELAARRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 118 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGRPVQVEARHCLVKSCPVIDQYLEPSTVETVSQYACQRRTTMEHHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPYDNFAFALLGWTGSRQFERDLRRFARHERKMLLDNHALYDKTKKIFLPAKTEEDIFAHLGLDYIPPWQRNA

SEQ ID NO: 119 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEQNSADELWQWLQNSSLGDLSKIEVLDISWFTECMGAGKPVQIEARHCLVKSCPVIDQYLEPSTVETVSQYACQRRTTMENHNKIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 120 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEQNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQKQGILLYYDIVESTFDKTRLPCRKFEAMDHFQKCFAIIKLKKELAAGRVQKDWKAIRVDFVACPVDNFAFALLGWTGSRQFERDLRRFARHERKMLLDNHALYDKTKKIFLPAKTEEDIFAHLGLDYIPPWQRNA

SEQ ID NO: 121 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKRCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQRAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAARRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 122 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIAVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIQDILEYGQCSKVQDVLCDDRYQTIKLFTSVFGVGLKTAEKWYRKGLHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVVPPVDNFAFALLGWTGSRQFERDLRRFARHERKMLLDNHALYDKTKKIFLPAKTEEDIFAHLGLDYIPPWQRNA

SEQ ID NO: 123 - protein, 494 aa, Artificial Sequence
  Modified TdT Sequences
MLHIPIFPPIKKRQKLPESRNSCKYEVKFSEVAIFLVERKMGSSRRKFLTNLARSKGFRIENVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLQRLINRLQKQGILLYYDIVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 124 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIQDILEYGQCSKVQDVLCDDRYQTIKLFTSVFGVGLKTAEKWYRKGFHSLEEVQADNAIHFTKMQKAGFLYYDDINAAVCKAEAQAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 125 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAENNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQRAGFLYYDDISAAVCKAEADAIGQIVEETVRLIAPDAIVTLTGGFRRGKECGHDVDFLITSPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 126 - protein, 494 aa, Artificial Sequence
  Modified TdT Sequences
MLHIPIFPPIKKRQKLPESRNSCKYEVKFSEIAIFLVERKMGSSRRKFLTNLARSKGFRIEDVLSDAITHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGLLLYYDIVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 127 - protein, 494 aa, Artificial Sequence
  Modified TdT Sequences
MLHIPIFPPIKKRQKLPESRNSCKYEVKFSEVAIFLVERKMGSSRRKFLTNLGRSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQSIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVVPPVDNFAFALLGWTGSRQFERDLRRFARHERKMLLDNHALYDKTKKIFLPAKTEEDIFAHLGLDYIPPWQRNA

SEQ ID NO: 128 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKRVIEDILEYGQCSKVQDVLCDDRYQTIKLFTSVFGVGLKTAEKWYRKGFHSLEEVKADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIDPWQRNA

SEQ ID NO: 129 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLRDLSKIEVLDISWFTECMEAGKPVQIEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVACPVDNFAFALLGWTGSRQFERDLRRFARHERKMLLDNHALYDKTKKIFLPAKTEEDIFAHLGLDYIPPWQRNA

SEQ ID NO: 130 - protein, 494 aa, Artificial Sequence
  Modified TdT Sequences
MLHIPIFPPIKKRQKLPESRNSCKYEVKFSEVAIFLVERKMGASRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNSIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPYDNFAFALLGWTGSRQFERDLRRFARHERKMLLDNHALYDKTKKIFLPAKTEEDIFAHLGLDYIPPWQRNA

SEQ ID NO: 131 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVEVEARHCLVKSCPVIDQYLEPSTVETVSQYACQRRTTMENHNQIFTDAFAILAENAEFNESEGPCLAFRRAASLLKSLPHPISSSKDLEGLPCLGDQTKAVIEDILEYGQCSKVQDVLCDDRYQTIKLFTSVFGVGLKTAEKWYRKGFHSLEEVQADNSIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVACPVDNFAFALLGWTGSRQFERDLRRFARHERKMLLDNHALYDKTKKIFLPAKTEEDIFAHLGLDYIPPWQRNA

SEQ ID NO: 132 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTSAVIEDILEYGQCSKVQDVLCDDRYQTIKLFTSVFGVGLKTAEKWYRKGFHSLEEVQADNAIHFTKMQKAGFLYYDDISAAVCKAEAQAIGQIVEETVRLIAPDAIVTLTGGFRRGKECGHDVDFLITSPEMGKEVWLLNRLINRLQNQGILLYYDIVESTFDKTRLPCRKFEAMDHFQKCFAIIKLKKELAAGRVQKDWKAIRVDFVVPPVDNFAFALLGWTGSRQFERDLRRFARHERKMLLDNHALYDKTKKIFLPAKTEEDIFAHLGLDYIPPWQRNA

SEQ ID NO: 133 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHIVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIQDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVACPVDNFAFALLGWTGSRQFERDLRRFARHERKMLLDNHALYDKTKKIFLPAKTEEDIFAHLGLDYIPPWQRNA

SEQ ID NO: 134 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEQNSADELWQWLQNSSLGDLSKIEVLDISWFTECMEAGKPVQIEARHCLVKSCPVIDQYLEPSTVETVSQYACQRRTTMENHNQIFTDAFAILAENAEFNESEGPCVAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 135 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNRIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNKGILLYYDIVESTFDKTRLPCRKFEAMDHFQKCFAIIKLKKELAAGRVQKDWKAIRVDFVACPVDNFAFALLGWTGSRQFERDLRRFARHERKMLLDNHALYDKTKKIFLPAKTEEDIFAHLGLDYIPPWQRNA

SEQ ID NO: 136 - protein, 494 aa, Artificial Sequence
  Modified TdT Sequences
MLHIPIFPPIKKRQKLPESRNSCKYEVKFSEVAIFLVERKMGASRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAVLAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHTLEEVQADNAIHFTKMQKAGFLYYDDISAAVCKAEAQAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 137 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQIEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVACPVDNFAFALLGWTGSRQFERDLRRWARHERKMILDNHALYDKTKKIFLPAKTEEDIFAHLGLDYIPPWQRNA

SEQ ID NO: 138 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLRDLSKIEVLDISWFTECMEAGKPVQVEARHCLVKRCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKNCGHDVDFLITTPEMGKEVWLLNRLINRLQNQGILLYYDIVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 139 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQIEARHCLVKSCPVIDQYLEPSTVETVSQYACQRRTTMENHNQIFTDAFAILAENAEFNESEGPCLAFRRAASLLKSLPHAISSSKDLEGLPCLGDQSKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMCPVDNFAFALLGWTGSRQFERDLRRFARHERKMLLDNHALYDKTKKIFLPAKTEEDIFAHLGLDYIPPWQRNA

SEQ ID NO: 140 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAENNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQSIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 141 - protein, 494 aa, Artificial Sequence
  Modified TdT Sequences
MLHIPIFPPIKKRQKLPESRNSCKYEVKFSEVVIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENCNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKERAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 142 - protein, 494 aa, Artificial Sequence
  Modified TdT Sequences
MLHIPIFPPIKKRQKLPESRNSCKYEVKFSEVVIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSPYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMCPVDNFAFALLGWTGSRQFERDLRRFARHERKMLLDNHALYDKTKKIFLPAKTEEDIFAHLGLDYIPPWQRNA

SEQ ID NO: 143 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQSEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEEAVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVACPVDNFAFALLGWTGSRQFERDLRRFARHERKMLLDNHALYDKTKKIFLPAKTEEDIFAHLGLDYIPPWQRNA

SEQ ID NO: 144 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEQNSADELWQWLQNSSLGDLSKIEVLDISWFTECMEAGKPVQVEARHCLVKSCPVIDQYLEPSTVETVSQYACQRRTTMENHNRIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 145 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSAVETVSPYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMCPVDNFAFALLGWTGSRQFERDLRRFARHERKMLLDNHALYDKTKKIFLPAKTEEDIFAHLGLDYIPPWQRNA

SEQ ID NO: 146 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAENNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHPISSSKDLEGLPCLGDQTKAVIEDILEYGQCSKVQDVLCDDRYQTIKLFTSVFGVGLKTAEKWYRKGFHSLEEVKADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 147 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGRPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTSAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPQMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 148 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVKADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAAPVDNFAFALLGWTGSRQFERDLRRFARHERKMLLDNHALYDKTKKIFLPAKTEEDIFAHLGLDYIPPWQRNA

SEQ ID NO: 149 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGLHSLEEVQADNAIHFTKMQRAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVACPVDNFAFALLGWTGSRQFERDLRRFARHERKMLLDNHALYDKTKKIFLPAKTEEDIFAHLGLDYIPPWQRNA

SEQ ID NO: 150 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAITHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCRAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMCPVDNFAFALLGWTGSRQFERDLRRFARHERKMLLDNHALYDKTKKIFLPAKTEEDIFAHLGLDYIPPWQRNA

SEQ ID NO: 151 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITSPEMGKEVWLLNRLINRLQNQGILLYYDIVESTFDKTRLPCRKFEAMDHFQKCFAIIKLKKELAAGRVQKDWKAIRVDFVACPVDNFAFALLGWTGSRQFERDLRRFARHEKKMLLDNHALYDKTKKIFLPAKTEEDIFAHLGLDYIPPWQRNA

SEQ ID NO: 152 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHIVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFMRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 153 - protein, 494 aa, Artificial Sequence
  Modified TdT Sequences
MLHIPIFPPIKKRQKLPESRNSCKYEVKFSEVAIFLVERKMGASRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIQDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDAFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 154 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHPISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDAFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIDPWQRNA

SEQ ID NO: 155 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSRDLEGLPCLGDQTKAVIEDILEYGQCSKVQDVLCDDRYQTIKLFTSVFGVGLKTAEKWYRKGFHSLEEVQADKAIHFTKMQRAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMCPVDNFAFALLGWTGSRQFERDLRRFARHERKMLLDNHALYDKTKKIFLPAKTEEDIFAHLGLDYIPPWQRNA

SEQ ID NO: 156 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHIVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQSIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPQMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 157 - protein, 494 aa, Artificial Sequence
  Modified TdT Sequences
MLHIPIFPPIKKRQKLPESRNSCKYEVKFSEVAIFLVERKMGASRRKFLTNLARSKGFRIEDVLSDAVTHIVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEEAVRLIAPDAIVTLTGGFRRGKECGHDVDFLITTPEMGKEVWLLNRLINRLQNQGILLYCDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 158 - protein, 494 aa, Artificial Sequence
  Modified TdT Sequences
MLHIPIFPPIKKRQKLPESRNSCKYEVKFSEVAIFLVERKMGSSRRAFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNKIFTDAFAILAENAEFNESEGPCLAFRRAASLLKSLPHAISSSKDLEGLPCLGDQTKRVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPYDNFAFALLGWTGSRQFERDLRRFARHERKMLLDNHALYDKTKKIFLPAKTEEDIFAHLGLDYIPPWQRNA

SEQ ID NO: 159 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCVAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKNCGHDVDFLITTPEMGKEVWLLNRLINRLQNQGILLYYDIVESTFDKTRLPCRKFEAMDHFQKCFAIIKLKKELAAGRVQKDWKAIRVDFVMAPVDNFAFALLGWTGSRQFERDLRRFARHERKMLLDNHALYDKTKKIFLPAKTEEDIFAHLGLDYIPPWQRNA

SEQ ID NO: 160 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIAVLDISWFTECMGAGKPVQIEARHCLVKSCPVIDQYLEPSTVETVSQYACQRRTTMENHNQIFTDAFAILAENAEFNESEGPCLAFRRAASLLKSLPHAISSSKDLEGLPCLGDQSKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 161 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKRCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEAQAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 162 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHIVAEDNSADELWQWLQNSSLGDLSKIAVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEAQAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIDPWQRNA

SEQ ID NO: 163 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSRDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVMAPVDNFAFALLGWTGSKQFERDLRRFARHERKMLLDNHALYDKTKKIFLPAKTEEDIFAHLGLDYIPPWQRNA

SEQ ID NO: 164 - protein, 494 aa, Artificial Sequence
  Modified TdT Sequences
MLHIPIFPPIKKRQKLPESRNSCKYEVKFSEVAIFLVERKMGSSRRAFLTNLARSKGFRIEDVLSDAVTHVVAEDNSADELWQWLQNSSLGDLSKIEVLDISWFTECMGAGKPVEVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVKADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 165 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQSKAVIEDILEYGQCSKVQDVLCDDRYQTIKLFTSVFGVGLKTAEKWYRKGFHTLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 166 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNKIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVKADNAIHFTKMQKAGFLYYDDISAAVCKAEADAIGQIVEEAVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 167 - protein, 494 aa, Artificial Sequence
  Modified TdT Sequences
MLHIPIFPPIKKRQKLPESRNSCKYEVKFSEVAIFLVERKMGSSRRKFLTNLGRSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQSKAVIEDILEYGQCSKVQDVLCDDRYQTIKLFTSVFGVGLKTAEKWYRKGFHSLEEVQADNAIHFTKMQKAGFLYYDDINAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 168 - protein, 494 aa, Artificial Sequence
  Modified TdT Sequences
MLHIPIFPPIKKRQKLPESRNSCKYEVKFSEVAIFLVERKMGSSRRKFLTNLARSKGFRIENVLSDAVTHVVAEDNSADELWQWLQNSSLGDLSKIEVLDISWFTECMEAGKPVQVEARHCLVKSCPVIDQYLEPSAVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVACPVDNFAFALLGWTGSRQFERDLRRFARHERKMLLDNHALYDKTKKIFLPAKTEEDIFAHLGLDYIPPWQRNA

SEQ ID NO: 169 - protein, 494 aa, Artificial Sequence
  Modified TdT Sequences
MLHIPIFPPIKKRQKLPESRNSCKYEVKFREVAIFLVERKMGSSRRKFLTNLARSKGFRIEDVLSDAVTHVVAEQNSADELWQWLQNSSLGDLSKIEVLDISWFTECMGAGKPVEVEARHCLVKSCPVIDQYLEPSTVETVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEEAVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 170 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGRPVQVEARHCLVKSCPVIDQYLEPSTVETVSQYACQRRTTMENHNKIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVACPVDNFAFALLGWTGSRQFERDLRRFARHERKMLLDNHALYDKTKKIFLPAKTEEDIFAHLGLDYIPPWQRNA

SEQ ID NO: 171 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQIEARHCLVKSCPVIDQYLEPSTVETVSQYACQRRTTMENHNQIFTDAFAILAENAEFNESEGPCLEFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVACPVDNFAFALLGWTGSRQFERDLRRFARHERKMLLDNHALYDKTKKIFLPAKTEEDIFAHLGLDYIPPWQRNA

SEQ ID NO: 172 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMGAGKPVQVEARHCLVKSCPVIDQYLEPSTVETVSQYACQRRTTMENHNQIFTDAFAILAENAEFNESEGPCLAFRRAASLLKSLPHAISSSKDLEGLPCLGDQTKRVIEDILEYGQCSKVQDVLCDDRYQTIKLFTSVFGVGLKTAEKWYRKGLHTLEEVQADNAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 173 - protein, 494 aa, Artificial Sequence
  Modified TdT Sequences
MLHIPIFPPIKKRQKLPESRNSCKYEVKFSEVAIFLVERKMGSSRRKFLTNLARSKGFRIEDVLSDAVTHVVAEDNSADELWQWLQNSSLGDLSKIEVLDISWFTECMEAGKPVQVEARHCLVKSCPVIDQYLEPSTVETVSQYACQRRTTMENHNRIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVACPVDNFAFALLGWTGSKQFERDLRRFARHERKMLLDNHALYDKTKKIFLPAKTEEDIFAHLGLDYIPPWQRNA

SEQ ID NO: 174 - protein, 354 aa, Artificial Sequence
  Modified TdT Sequences
TVSQYACQRRTTMENHNQIFTDAFAILAENAEFNESEDPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 175 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEAQAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRWARHERKMLLDNHALYDKTKKIFLPAKTEEDIFAHLGLDYIPPWQRNA

SEQ ID NO: 176 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHTLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVVCPVDNFAFALLGWTGSRQFERDLRRFARHERKMLLDNHALYDKTKKIFLPAKTEEDIFAHLGLDYIPPWQRNA

SEQ ID NO: 177 - protein, 354 aa, Artificial Sequence
  Modified TdT Sequences
TVSPYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQRAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 178 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIQDILEYGQCSKVQDVLCDDRYQTIKLFTSVFGVGLKTAEKWYRKGFHSLEEVQADNSIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMILDNHALYDKTKKIFLPAKTEEDIFAHLGLDYIPPWQRNA

SEQ ID NO: 179 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHEKKMLLDNHALYDKTKKIFLPAKTEEDIFAHLGLDYIPPWQRNA

SEQ ID NO: 180 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKNWKAIRVDFVMCPVDNFAFALLGWTGSRQFERDLRRFARHERKMLLDNHALYDKTKKIFLPAKTEEDIFAHLGLDYIPPWQRNA

SEQ ID NO: 181 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNTIHFTKMQKAGFLYYDDISAAVCKAEAQAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 182 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEAQAIGQIVEETVRLIAPDAIVTLTGGFRRGKNCGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 183 - protein, 354 aa, Artificial Sequence
  Modified TdT Sequences
TVSQYACQRRTTMENHNKIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGLHSLEEVQADNTIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 184 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQRAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 185 - protein, 354 aa, Artificial Sequence
  Modified TdT Sequences
TVSQYACQRRTTMEHHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITSPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 186 - protein, 354 aa, Artificial Sequence
  Modified TdT Sequences
TVSQYACQRRTTMENHNQIFTDAFAVLAENAEFNESEGPCLAFRRAASLLKSLPHAISSSKDLEGLPCLGDQTKAVIQDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIDPWQRNA

SEQ ID NO: 187 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVVPPVDNFAFALLGWTGSRQFERDLRRFARHERKMILDNHALYDKTKKIFLPAKTEEDIFAHLGLDYIPPWQRNA

SEQ ID NO: 188 - protein, 354 aa, Artificial Sequence
  Modified TdT Sequences
TVSQYACQRRTTMENCNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKNWKAIRVDFVMPPVDNFAFALLGWTGSRQFERDLRRFARHERKMLLDNHALYDKTKKIFLPAKTEEDIFAHLGLDYIPPWQRNA

SEQ ID NO: 189 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCRAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKERAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 190 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 191 - protein, 354 aa, Artificial Sequence
  Modified TdT Sequences
TVSQYACQRRTTMENHNKIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAAPVDNFAFALLGWTGSRQFERDLRRFARHERKMLLDNHALYDKTKKIFLPAKTEEDIFAHLGLDYIPPWQRNA

SEQ ID NO: 192 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIQDILEYGQCSKVQDVLCDDRYQTIKLFTSVFGVGLKTAEKWYRKGFHSLEEVQADNTIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 193 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKERAAGRVQKNWKAIRVDFVMPPVDNFAFALLGWTGSRQFERDLRRFARHERKMLLDNHALYDKTKKIFLPAKTEEDIFAHLGLDYIPPWQRNA

SEQ ID NO: 194 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMCPVDNFAFALLGWTGSRQFERDLRRFARHERKMLLDNHALYDKTKKIFLPAKTEEDIFAHLGLDYIPPWQRNA

SEQ ID NO: 195 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVKADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVVPPVDNFAFALLGWTGSRQFERDLRRFARHERKMLLDNHALYDKTKKIFLPAKTEEDIFAHLGLDYIPPWQRNA

SEQ ID NO: 196 - protein, 354 aa, Artificial Sequence
  Modified TdT Sequences
TVSQYACQRRTTMEHHNQIFTDAFAILAENAEFNESEGPCLAFRRAASLLKSLPHAISSSKDLEGLPCLGDQTKRVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 197 - protein, 354 aa, Artificial Sequence
  Modified TdT Sequences
TVSQYACQRRTTMENHNQIFTDAFAILAENAEFNESEDPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQRAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVACPVDNFAFALLGWTGSRQFERDLRRFARHERKMLLDNHALYDKTKKIFLPAKTEEDIFAHLGLDYIPPWQRNA

SEQ ID NO: 198 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIQDILEYGQCSKVQDVLCDDRYQTIKLFTSVFGVGLKTAEKWYRKGFHSLEEVKADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 199 - protein, 354 aa, Artificial Sequence
  Modified TdT Sequences
TVSQYACQRRTTMENHNKIFTDAFAILAENAEFNESEGPCLAFRRAASLLKSLPHAISSSKDLEGLPCLGDQTKAVIQDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 200 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVACPVDRFAFALLGWTGSRQFERDLRRFARHERKMLLDNHALYDKTKKIFLPAKTEEDIFAHLGLDYIPPWQRNA

SEQ ID NO: 201 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKNWKAIRVDFVLCPVDNFAFALLGWTGSRQFERDLRRFARHERKMLLDNHALYDKTKKIFLPAKTEEDIFAHLGLDYIPPWQRNA

SEQ ID NO: 202 - protein, 354 aa, Artificial Sequence
  Modified TdT Sequences
TVSQYACQRRTTMENHNQIFTDAFAVLAENAEFNESEGPCLAFRRAASLLKSLPHPISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAAPVDNFAFALLGWTGSRQFERDLRRFARHERKMLLDNHALYDKTKKIFLPAKTEEDIFAHLGLDYIPPWQRNA

SEQ ID NO: 203 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDINAAVCKAEADAIGQIVEETVRLIAPDAIVTLTGGFRRGKECGHDVDFLITTPQMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 204 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHTLEEVQADNAIHFTKMQKAGFLYYDDISAAVCKAEADAIGQIVEEAVRLIAPDAIVTLTGGFRRGKECGHDVDFLITSPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 205 - protein, 354 aa, Artificial Sequence
  Modified TdT Sequences
TVSQYACQRRTTMENHNQIFTDAFAILAENAEFNESEDPCLAFRRAASLLKSLPHAISSSRDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 206 - protein, 354 aa, Artificial Sequence
  Modified TdT Sequences
TVSQYACQRRTTMEHHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPQMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 207 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMRKEQLLPKVINLWEKKGLLLYYDLVESTFDKTRLPCRKFEAMDHFQKCFAIIKLKKELAAGRVQKDWKAIRVDFVAAPVDNFAFALLGWTGSRQFERDLRRFARHERKMLLDNHALYDKTKKIFLPAKTEEDIFAHLGLDYIPPWQRNA

SEQ ID NO: 208 - protein, 354 aa, Artificial Sequence
  Modified TdT Sequences
TVSQYACQRRTTMENHNQIFTDAFAILAENAEFNESEGPCVAFRRAASLLKSLPHAISSSKDLEGLPCLGDQSKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAARRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 209 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVLAPVDNFAFALLGWTGSRQFERDLRRFARHERKMLLDNHALYDKTKKIFLPAKTEEDIFAHLGLDYIPPWQRNA

SEQ ID NO: 210 - protein, 354 aa, Artificial Sequence
  Modified TdT Sequences
TVSQYACQRRTTMENHNQIFTDAFAILAENAEFNESEGPCLEFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 211 - protein, 354 aa, Artificial Sequence; identical to SEQ ID NO: 190
  Modified TdT Sequences

SEQ ID NO: 212 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKRVIEDILEYGQCSKVQDVLCDDRYQTIKLFTSVFGVGLKTAEKWYRKGFHSLEEVQADNAIHFTKMQRAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 213 - protein, 354 aa, Artificial Sequence
  Modified TdT Sequences
TVSQYACQRRTTMENHNQMFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEAQAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMCPVDNFAFALLGWTGSRQFERDLRRFARHERKMLLDNHALYDKTKKIFLPAKTEEDIFAHLGLDYIPPWQRNA

SEQ ID NO: 214 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGLHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHEKKMLLDNHALYDKTKKIFLPAKTEEDIFAHLGLDYIPPWQRNA

SEQ ID NO: 215 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQSKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 216 - protein, 354 aa, Artificial Sequence
  Modified TdT Sequences
TVSQYACQRRTTMENHNQIFTDAFAILAENAEFNESEGPCLAFRRAASLLKSLPHPISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEAQAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 217 - protein, 354 aa, Artificial Sequence; identical to SEQ ID NO: 190
  Modified TdT Sequences

SEQ ID NO: 218 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVLPPVDRFAFALLGWTGSRQFERDLRRFARHERKMLLDNHALYDKTKKIFLPAKTEEDIFAHLGLDYIPPWQRNA

SEQ ID NO: 219 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMCPVDNFAFALLGWTGSRQFERDLRRFARHERKMLLDNHALYDKTKKIFLPAKTEEDIFAHLGLDYIPPWQRNA

SEQ ID NO: 220 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQSIKLFTSVFGVGLKTAEKWYRKGFHSLEEVQADNAIHFTKMQKAGFLYYDDISAAVCKAEAQAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 221 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITSPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 222 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQSKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMCPVDNFAFALLGWTGSRQFERDLRRFARHERKMLLDNHALYDKTKKIFLPAKTEEDIFAHLGLDYIPPWQRNA

SEQ ID NO: 223 - protein, 354 aa, Artificial Sequence
  Modified TdT Sequences
TVSQYACQRRTTMENHNQIFTDAFAILAENAEFNESEGPCLAFRRAASLLKSLPHPISSSKDLEGLPCLGDQSKAVIEDILEYGQCSKVQDVLCDDRYQTIKLFTSVFGVGLKTAEKWYRKGLHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 224 - protein, 354 aa, Artificial Sequence
  Modified TdT Sequences
TVSQYACQRRTTMENHNQIFTDAFAILAENAEFNESEGPCLAFMRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEAQAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHEKKMLLDNHALYDKTKKIFLPAKTEEDIFAHLGLDYIPPWQRNA

SEQ ID NO: 225 - protein, 354 aa, Artificial Sequence
  Modified TdT Sequences
TVSQYACQRRTTMENHNRIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMAPVDNFAFALLGWTGSRQFERDLRRFARHERKMLLDNHALYDKTKKIFLPAKTEEDIFAHLGLDYIPPWQRNA

SEQ ID NO: 226 - protein, 354 aa, Artificial Sequence
  Modified TdT Sequences
TVSQYACQRRTTMENHNQIFTDAFAILAENAEFNESEGPCLEFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAAPVDNFAFALLGWTGSRQFERDLRRFARHERKMLLDNHALYDKTKKIFLPAKTEEDIFAHLGLDYIPPWQRNA

SEQ ID NO: 227 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQSKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 228 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTSAVIEDILEYGQCSKVQDVLCDDRYQTIKLFTSVFGVGLKTAEKWYRKGFHTLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 229 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNSIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 230 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 231 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSKQFERDLRRFARHERKMLLDNHALYDKTKKIFLPAKTEEDIFAHLGLDYIPPWQRNA

SEQ ID NO: 232 - protein, 354 aa, Artificial Sequence; identical to SEQ ID NO: 194
  Modified TdT Sequences

SEQ ID NO: 233 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNTIHFTKMQKAGFLYYDDISAAVCKAEADAIGQIVEEAVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 234 - protein, 354 aa, Artificial Sequence
  Modified TdT Sequences
TVSQYACQRRTTMENHNQIFTDAFAILAENAEFNESEDPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 235 - protein, 354 aa, Artificial Sequence
  Modified TdT Sequences
TVSPYACQRRTTMENHNQIFTDAFAILAENAEFNESEGPCLAFRRAASLLKSLPHAISSSRDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEAQAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 236 - protein, 354 aa, Artificial Sequence
  Modified TdT Sequences
TVSQYACQRRTTMENCNQIFTDAFAILAENAEFNESEGPCLAFRRAASLLKSLPHAISSSKDLEGLPCLGDQSKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMAPVDNFAFALLGWTGSRQFERDLRRFARHERKMLLDNHALYDKTKKIFLPAKTEEDIFAHLGLDYIPPWQRNA

SEQ ID NO: 237 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPQMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHEKKMLLDNHALYDKTKKIFLPAKTEEDIFAHLGLDYIPPWQRNA

SEQ ID NO: 238 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQSKAVIEDILEYGQCSKVQDVLCDDRYQTIKLFTSVFGVGLKTAEKWYRKGFHSLEEVQADNAIHFTKMQRAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVVPPVDNFAFALLGWTGSRQFERDLRRFARHERKMLLDNHALYDKTKKIFLPAKTEEDIFAHLGLDYIPPWQRNA

SEQ ID NO: 239 - protein, 354 aa, Artificial Sequence
  Modified TdT Sequences
TVSQYACQRRTTMENHNQIFTDAFAILAENAEFNESEGPCLAFMRAASLLKSLPHPISSSKDLEGLPCLGDQTSAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 240 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQRAGFLYYDDISAAVCKAEADAIGQIVEETVRLIAPDAIVTLTGGFRRGKECGHDVDFLITTPEMRKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 241 - protein, 354 aa, Artificial Sequence
  Modified TdT Sequences
TVSQYACQRRTTMENHNQMFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 242 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVVAPVDNFAFALLGWTGSRQFERDLRRWARHERKMLLDNHALYDKTKKIFLPAKTEEDIFAHLGLDYIPPWQRNA

SEQ ID NO: 243 - protein, 354 aa, Artificial Sequence
  Modified TdT Sequences
TVSQYACQRRTTMENCNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEAQAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVACPVDNFAFALLGWTGSRQFERDLRRFARHERKMLLDNHALYDKTKKIFLPAKTEEDIFAHLGLDYIPPWQRNA

SEQ ID NO: 244 - protein, 354 aa, Artificial Sequence
  Modified TdT Sequences
TVSQYACQRRTTMENHNQIFTDAFAILAENAEFNESEGPCLEFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMRKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 245 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVWLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVACPVDNFAFALLGWTGSRQFERDLRRFARHERKMLLDNHALYDKTKKIFLPAKTEEDIFAHLGLDYIPPWQRNA

SEQ ID NO: 246 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTSAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMILDNHALYDKTKKIFLPAKTEEDIFAHLGLDYIPPWQRNA

SEQ ID NO: 247 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQSKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVWLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMCPVDNFAFALLGWTGSRQFERDLRRFARHERKMLLDNHALYDKTKKIFLPAKTEEDIFAHLGLDYIPPWQRNA

SEQ ID NO: 248 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKRVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 249 - protein, 354 aa, Artificial Sequence
  Modified TdT Sequences
TVSQYACQRRTTMENHNQIFTDAFAVLAENAEFNESEGPCLAFRRAASLLKSLPHAISSSKDLEGLPCLGDQSKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRWARHERKMLLDNHALYDKTKKIFLPAKTEEDIFAHLGLDYIPPWQRNA

SEQ ID NO: 250 - protein, 354 aa, Artificial Sequence
  Modified TdT Sequences
TVSQYACQRRTTMENHNKIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEAQAIGQIVEETVRLIAPDAIVTLTGGFRRGKECGHDVDFLITTPEMGKEQLLPKVINLWEKKGLLLYYDLVESTFDKTRLPCRKFEAMDAFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 251 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEEAVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIDPWQRNA

SEQ ID NO: 252 - protein, 354 aa, Artificial Sequence; identical to SEQ ID NO: 184
  Modified TdT Sequences

SEQ ID NO: 253 - protein, 354 aa, Artificial Sequence
  Modified TdT Sequences
TVSQYACQRRTTMENHNQIFTDAFAILAENAEFNESEGPCLAFRRAASLLKSLPHPISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMILDNHALYDKTKKIFLPAKTEEDIFAHLGLDYIPPWQRNA

SEQ ID NO: 254 - protein, 354 aa, Artificial Sequence
  Modified TdT Sequences
TVSQYACQRRTTMENHNQIFTDAFAILAENAEFNESEGPCLAFMRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITSPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 255 - protein, 354 aa, Artificial Sequence
  Modified TdT Sequences
TVSQYACQRRTTMENHNQIFTDAFAILAENAEFNESEGPCVAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMCPVDNFAFALLGWTGSRQFERDLRRFARHERKMLLDNHALYDKTKKIFLPAKTEEDIFAHLGLDYIPPWQRNA

SEQ ID NO: 256 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVACPYDNFAFALLGWTGSRQFERDLRRFARHERKMLLDNHALYDKTKKIFLPAKTEEDIFAHLGLDYIPPWQRNA

SEQ ID NO: 257 - protein, 354 aa, Artificial Sequence
  Modified TdT Sequences
TVSQYACQRRTTMENHNQIFTDAFAILAENAEFNESEGPCLAFMRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEEAVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVVPPVDNFAFALLGWTGSRQFERDLRRFARHERKMLLDNHALYDKTKKIFLPAKTEEDIFAHLGLDYIPPWQRNA

SEQ ID NO: 258 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKNCGHDVDFLITTPEMGKEQLLPKVINLWEKKGLLLYYDLVESTFDKTRLPCRKFEAMDHFQKCFAIIKLKKELAAGRVQKDWKAIRVDFVLCPVDNFAFALLGWTGSRQFERDLRRFARHERKMLLDNHALYDKTKKIFLPAKTEEDIFAHLGLDYIPPWQRNA

SEQ ID NO: 259 - protein, 354 aa, Artificial Sequence; identical to SEQ ID NO: 200
  Modified TdT Sequences

SEQ ID NO: 260 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEAQAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 261 - protein, 354 aa, Artificial Sequence
  Modified TdT Sequences
TVSQYACQRRTTMEHHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHTLEEVQADNSIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 262 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGLHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAAPVDNFAFALLGWTGSRQFERDLRRFARHERKMLLDNHALYDKTKKIFLPAKTEEDIFAHLGLDYIPPWQRNA

SEQ ID NO: 263 - protein, 354 aa, Artificial Sequence
  Modified TdT Sequences
TVSQYACQRRTTMENHNKIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVVPPVDNFAFALLGWTGSRQFERDLRRFARHEKKMLLDNHALYDKTKKIFLPAKTEEDIFAHLGLDYIPPWQRNA

SEQ ID NO: 264 - protein, 354 aa, Artificial Sequence
  Modified TdT Sequences
TVSQYACQRRTTMENHNQMFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMRKEQLLPKVINLWEKKGLLLYYDLVESTFDKTRLPCRKFEAMDHFQKCFAIIKLKKELAAGRVQKDWKAIRVDFVLCPVDNFAFALLGWTGSRQFERDLRRFARHERKMLLDNHALYDKTKKIFLPAKTEEDIFAHLGLDYIPPWQRNA

SEQ ID NO: 265 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHTLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIDPWQRNA

SEQ ID NO: 266 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQSKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 267 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEAQAIGQIVEETVWLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSKQFERDLRRFARHERKMLLDNHALYDKTKKIFLPAKTEEDIFAHLGLDYIPPWQRNA

SEQ ID NO: 268 - protein, 354 aa, Artificial Sequence
  Modified TdT Sequences
TVSQYACQRRTTMENHNQIFTDAFAILAENAEFNESEGPCLAFMRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDINAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 269 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGLHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 270 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQRAGFLYYDDISAAVCRAEAQAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 271 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVACPVDNFAFALLGWTGSRQFERDLRRFARHERKMLLDNHALYDKTKKIFLPAKTEEDIFAHLGLDYIPPWQRNA

SEQ ID NO: 272 - protein, 354 aa, Artificial Sequence; identical to SEQ ID NO: 241
  Modified TdT Sequences

SEQ ID NO: 273 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEAQAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVACPVDNFAFALLGWTGSRQFERDLRRFARHERKMLLDNHALYDKTKKIFLPAKTEEDIFAHLGLDYIPPWQRNA

SEQ ID NO: 274 - protein, 354 aa, Artificial Sequence
  Modified TdT Sequences
TVSQYACQRRTTMENHNQIFTDAFAVLAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVKADNTIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 275 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQSIKLFTSVFGVGLKTAEKWYRKGLHSLEEVQADNAIHFTKMQKAGFLYYDDINAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 276 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDAFQKCFAIIKLKKELAAGRVQKDWKAIRVDFVAPPYDNFAFALLGWTGSRQFERDLRRFARHERKMLLDNHALYDKTKKIFLPAKTEEDIFAHLGLDYIPPWQRNA

SEQ ID NO: 277 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMAPVDNFAFALLGWTGSRQFERDLRRFARHERKMLLDNHALYDKTKKIFLPAKTEEDIFAHLGLDYIPPWQRNA

SEQ ID NO: 278 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDRFAFALLGWTGSRQFERDLRRFARHERKMLLDNHALYDKTKKIFLPAKTEEDIFAHLGLDYIPPWQRNA

SEQ ID NO: 279 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIQDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 280 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEAQAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 281 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGLHSLEEVQADNAIHFTKMQKAGFLYYDDISAAVCKAEADAIGQIVEETVRLIAPDAIVTLTGGFRRGKECGHDVDFLITSPEMGKEQLLPKVINLWEKKGLLLYYDLVESTFDKTRLPCRKFEAMDAFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 282 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAARRVQKDWKAIRVDFVACPVDNFAFALLGWTGSRQFERDLRRFARHERKMLLDNHALYDKTKKIFLPAKTEEDIFAHLGLDYIPPWQRNA

SEQ ID NO: 283 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQSKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 284 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQSKAVIEDILEYGQCSKVQDVLCDDRYQTIKLFTSVFGVGLKTAEKWYRKGFHSLEEVQADKAIHFTKMQKAGFLYYDDISAAVCRAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 285 - protein, 354 aa, Artificial Sequence
  Modified TdT Sequences
TVSQYACQRRTTMENHNKIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 286 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKERAAGRVQKDWKAIRVDFVMCPVDNFAFALLGWTGSRQFERDLRRFARHERKMLLDNHALYDKTKKIFLPAKTEEDIFAHLGLDYIPPWQRNA

SEQ ID NO: 287 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVWLIAPDAIVTLTGGFRRGKECGHDVDFLITTPEMGKEQLLPKVINLWEKKGLLLYYDLVESTFDKTRLPCRKFEAMDHFQKCFAIIKLKKELAARRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 288 - protein, 354 aa, Artificial Sequence
  Modified TdT Sequences
TVSQYACQRRTTMEHHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPYDNFAFALLGWTGSRQFERDLRRFARHERKMLLDNHALYDKTKKIFLPAKTEEDIFAHLGLDYIPPWQRNA

SEQ ID NO: 289 - protein, 354 aa, Artificial Sequence
  Modified TdT Sequences
TVSQYACQRRTTMENHNKIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 290 - protein, 354 aa, Artificial Sequence; identical to SEQ ID NO: 271
  Modified TdT Sequences

SEQ ID NO: 291 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQRAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAARRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 292 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIQDILEYGQCSKVQDVLCDDRYQTIKLFTSVFGVGLKTAEKWYRKGLHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVVPPVDNFAFALLGWTGSRQFERDLRRFARHERKMLLDNHALYDKTKKIFLPAKTEEDIFAHLGLDYIPPWQRNA

SEQ ID NO: 293 - protein, 354 aa, Artificial Sequence; identical to SEQ ID NO: 190
  Modified TdT Sequences

SEQ ID NO: 294 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIQDILEYGQCSKVQDVLCDDRYQTIKLFTSVFGVGLKTAEKWYRKGFHSLEEVQADNAIHFTKMQKAGFLYYDDINAAVCKAEAQAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 295 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQRAGFLYYDDISAAVCKAEADAIGQIVEETVRLIAPDAIVTLTGGFRRGKECGHDVDFLITSPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 296 - protein, 354 aa, Artificial Sequence; identical to SEQ ID NO: 190
  Modified TdT Sequences

SEQ ID NO: 297 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQSIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVVPPVDNFAFALLGWTGSRQFERDLRRFARHERKMLLDNHALYDKTKKIFLPAKTEEDIFAHLGLDYIPPWQRNA

SEQ ID NO: 298 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKRVIEDILEYGQCSKVQDVLCDDRYQTIKLFTSVFGVGLKTAEKWYRKGFHSLEEVKADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIDPWQRNA

SEQ ID NO: 299 - protein, 354 aa, Artificial Sequence; identical to SEQ ID NO: 271
  Modified TdT Sequences

SEQ ID NO: 300 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNSIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPYDNFAFALLGWTGSRQFERDLRRFARHERKMLLDNHALYDKTKKIFLPAKTEEDIFAHLGLDYIPPWQRNA

SEQ ID NO: 301 - protein, 354 aa, Artificial Sequence
  Modified TdT Sequences
TVSQYACQRRTTMENHNQIFTDAFAILAENAEFNESEGPCLAFRRAASLLKSLPHPISSSKDLEGLPCLGDQTKAVIEDILEYGQCSKVQDVLCDDRYQTIKLFTSVFGVGLKTAEKWYRKGFHSLEEVQADNSIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVACPVDNFAFALLGWTGSRQFERDLRRFARHERKMLLDNHALYDKTKKIFLPAKTEEDIFAHLGLDYIPPWQRNA

SEQ ID NO: 302 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTSAVIEDILEYGQCSKVQDVLCDDRYQTIKLFTSVFGVGLKTAEKWYRKGFHSLEEVQADNAIHFTKMQKAGFLYYDDISAAVCKAEAQAIGQIVEETVRLIAPDAIVTLTGGFRRGKECGHDVDFLITSPEMGKEQLLPKVINLWEKKGLLLYYDLVESTFDKTRLPCRKFEAMDHFQKCFAIIKLKKELAAGRVQKDWKAIRVDFVVPPVDNFAFALLGWTGSRQFERDLRRFARHERKMLLDNHALYDKTKKIFLPAKTEEDIFAHLGLDYIPPWQRNA

SEQ ID NO: 303 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIQDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVACPVDNFAFALLGWTGSRQFERDLRRFARHERKMLLDNHALYDKTKKIFLPAKTEEDIFAHLGLDYIPPWQRNA

SEQ ID NO: 304 - protein, 354 aa, Artificial Sequence
  Modified TdT Sequences
TVSQYACQRRTTMENHNQIFTDAFAILAENAEFNESEGPCVAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 305 - protein, 354 aa, Artificial Sequence
  Modified TdT Sequences
TVSQYACQRRTTMENHNRIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVACPVDNFAFALLGWTGSRQFERDLRRFARHERKMLLDNHALYDKTKKIFLPAKTEEDIFAHLGLDYIPPWQRNA

SEQ ID NO: 306 - protein, 354 aa, Artificial Sequence
  Modified TdT Sequences
TVSQYACQRRTTMENHNQIFTDAFAVLAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHTLEEVQADNAIHFTKMQKAGFLYYDDISAAVCKAEAQAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 307 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVACPVDNFAFALLGWTGSRQFERDLRRWARHERKMILDNHALYDKTKKIFLPAKTEEDIFAHLGLDYIPPWQRNA

SEQ ID NO: 308 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKNCGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 309 - protein, 354 aa, Artificial Sequence; identical to SEQ ID NO: 222
  Modified TdT Sequences

SEQ ID NO: 310 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQSIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 311 - protein, 354 aa, Artificial Sequence
  Modified TdT Sequences
TVSQYACQRRTTMENCNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKERAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 312 - protein, 354 aa, Artificial Sequence
  Modified TdT Sequences
TVSPYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMCPVDNFAFALLGWTGSRQFERDLRRFARHERKMLLDNHALYDKTKKIFLPAKTEEDIFAHLGLDYIPPWQRNA

SEQ ID NO: 313 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEEAVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVACPVDNFAFALLGWTGSRQFERDLRRFARHERKMLLDNHALYDKTKKIFLPAKTEEDIFAHLGLDYIPPWQRNA

SEQ ID NO: 314 - protein, 354 aa, Artificial Sequence
  Modified TdT Sequences
TVSQYACQRRTTMENHNRIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 315 - protein, 354 aa, Artificial Sequence; identical to SEQ ID NO: 312
  Modified TdT Sequences

SEQ ID NO: 316 - protein, 354 aa, Artificial Sequence
  Modified TdT Sequences
TVSQYACQRRTTMENHNQIFTDAFAILAENAEFNESEGPCLAFRRAASLLKSLPHPISSSKDLEGLPCLGDQTKAVIEDILEYGQCSKVQDVLCDDRYQTIKLFTSVFGVGLKTAEKWYRKGFHSLEEVKADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 317 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTSAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPQMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 318 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVKADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAAPVDNFAFALLGWTGSRQFERDLRRFARHERKMLLDNHALYDKTKKIFLPAKTEEDIFAHLGLDYIPPWQRNA

SEQ ID NO: 319 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGLHSLEEVQADNAIHFTKMQRAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVACPVDNFAFALLGWTGSRQFERDLRRFARHERKMLLDNHALYDKTKKIFLPAKTEEDIFAHLGLDYIPPWQRNA

SEQ ID NO: 320 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCRAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMCPVDNFAFALLGWTGSRQFERDLRRFARHERKMLLDNHALYDKTKKIFLPAKTEEDIFAHLGLDYIPPWQRNA

SEQ ID NO: 321 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITSPEMGKEQLLPKVINLWEKKGLLLYYDLVESTFDKTRLPCRKFEAMDHFQKCFAIIKLKKELAAGRVQKDWKAIRVDFVACPVDNFAFALLGWTGSRQFERDLRRFARHEKKMLLDNHALYDKTKKIFLPAKTEEDIFAHLGLDYIPPWQRNA

SEQ ID NO: 322 - protein, 354 aa, Artificial Sequence
  Modified TdT Sequences
TVSQYACQRRTTMENHNQIFTDAFAILAENAEFNESEGPCLAFMRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 323 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIQDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDAFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 324 - protein, 354 aa, Artificial Sequence
  Modified TdT Sequences
TVSQYACQRRTTMENHNQIFTDAFAILAENAEFNESEGPCLAFRRAASLLKSLPHPISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDAFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIDPWQRNA

SEQ ID NO: 325 - protein, 354 aa, Artificial Sequence
  Modified TdT Sequences
TVSQYACQRRTTMENHNQIFTDAFAILAENAEFNESEGPCLAFRRAASLLKSLPHAISSSRDLEGLPCLGDQTKAVIEDILEYGQCSKVQDVLCDDRYQTIKLFTSVFGVGLKTAEKWYRKGFHSLEEVQADKAIHFTKMQRAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMCPVDNFAFALLGWTGSRQFERDLRRFARHERKMLLDNHALYDKTKKIFLPAKTEEDIFAHLGLDYIPPWQRNA

SEQ ID NO: 326 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQSIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPQMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 327 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEEAVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 328 - protein, 354 aa, Artificial Sequence
  Modified TdT Sequences
TVSQYACQRRTTMENHNKIFTDAFAILAENAEFNESEGPCLAFRRAASLLKSLPHAISSSKDLEGLPCLGDQTKRVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPYDNFAFALLGWTGSRQFERDLRRFARHERKMLLDNHALYDKTKKIFLPAKTEEDIFAHLGLDYIPPWQRNA

SEQ ID NO: 329 - protein, 354 aa, Artificial Sequence
  Modified TdT Sequences
TVSQYACQRRTTMENHNQIFTDAFAILAENAEFNESEGPCVAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKNCGHDVDFLITTPEMGKEQLLPKVINLWEKKGLLLYYDLVESTFDKTRLPCRKFEAMDHFQKCFAIIKLKKELAAGRVQKDWKAIRVDFVMAPVDNFAFALLGWTGSRQFERDLRRFARHERKMLLDNHALYDKTKKIFLPAKTEEDIFAHLGLDYIPPWQRNA

SEQ ID NO: 330 - protein, 354 aa, Artificial Sequence; identical to SEQ ID NO: 283
  Modified TdT Sequences

SEQ ID NO: 331 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEAQAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDNHALYDKTKKIFLPAKTEEDIFAHLGLDYIPPWQRNA

SEQ ID NO: 332 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEAQAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIDPWQRNA

SEQ ID NO: 333 - protein, 354 aa, Artificial Sequence
  Modified TdT Sequences
TVSQYACQRRTTMENHNQIFTDAFAILAENAEFNESEGPCLAFRRAASLLKSLPHAISSSRDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMAPVDNFAFALLGWTGSKQFERDLRRFARHERKMLLDNHALYDKTKKIFLPAKTEEDIFAHLGLDYIPPWQRNA

SEQ ID NO: 334 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVKADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 335 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQSKAVIEDILEYGQCSKVQDVLCDDRYQTIKLFTSVFGVGLKTAEKWYRKGFHTLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 336 - protein, 354 aa, Artificial Sequence
  Modified TdT Sequences
TVSQYACQRRTTMENHNKIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVKADNAIHFTKMQKAGFLYYDDISAAVCKAEADAIGQIVEEAVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 337 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQSKAVIEDILEYGQCSKVQDVLCDDRYQTIKLFTSVFGVGLKTAEKWYRKGFHSLEEVQADNAIHFTKMQKAGFLYYDDINAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 338 - protein, 354 aa, Artificial Sequence; identical to SEQ ID NO: 271
  Modified TdT Sequences

SEQ ID NO: 339 - protein, 354 aa, Artificial Sequence; identical to SEQ ID NO: 327
  Modified TdT Sequences

SEQ ID NO: 340 - protein, 354 aa, Artificial Sequence
  Modified TdT Sequences
TVSQYACQRRTTMENHNKIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVACPVDNFAFALLGWTGSRQFERDLRRFARHERKMLLDNHALYDKTKKIFLPAKTEEDIFAHLGLDYIPPWQRNA

SEQ ID NO: 341 - protein, 354 aa, Artificial Sequence
  Modified TdT Sequences
TVSQYACQRRTTMENHNQIFTDAFAILAENAEFNESEGPCLEFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVACPVDNFAFALLGWTGSRQFERDLRRFARHERKMLLDNHALYDKTKKIFLPAKTEEDIFAHLGLDYIPPWQRNA

SEQ ID NO: 342 - protein, 354 aa, Artificial Sequence
  Modified TdT Sequences
TVSQYACQRRTTMENHNQIFTDAFAILAENAEFNESEGPCLAFRRAASLLKSLPHAISSSKDLEGLPCLGDQTKRVIEDILEYGQCSKVQDVLCDDRYQTIKLFTSVFGVGLKTAEKWYRKGLHTLEEVQADNAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIPPWQRNA

SEQ ID NO: 343 - protein, 354 aa, Artificial Sequence
  Modified TdT Sequences
TVSQYACQRRTTMENHNRIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVACPVDNFAFALLGWTGSKQFERDLRRFARHERKMLLDNHALYDKTKKIFLPAKTEEDIFAHLGLDYIPPWQRNA

SEQ ID NO: 344 - protein, 362 aa, Artificial Sequence
  Modified TdT Sequence
MENLYFQGTVSQYACQRRTTMENHNQVFTDAFAILAENAEFNESEGPCLAFRRAASLLKSLPHAISSSKDLEGLPCLGDQTKAVIEDIFEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYVPPWQRNA

SEQ ID NO: 345 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGCIVEETVRLIAPDAIVTLTGGFRRGKEIGHDVDFLITTPEAGKEQLLPKVIDLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 346 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDIIEYGQCSKVQDVLCDDRYQTIKLFTSVFGVGLKTAEKWYRKGFHSLEDVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDRTKKIFLPAKTEEDIFAHLGLDYIPPWQRNA

SEQ ID NO: 347 - protein, 362 aa, Artificial Sequence
  Modified TdT Sequence
MENLYFQGTVSQYACQRRTTTENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPDVINLLEKKGLLLYYHLVESTFDKTRLPCRKFEAMDHFQKCFAIIKLKKELAAGRVQKDWKAIRVDFVMPPADNFAFALLGWTGSRQFERDLRRFARHERKMLLDRHALYDKTKKIFLPAKTEEDIFAHLGLDYIPPWQRNA

SEQ ID NO: 348 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVLPPIDRFAFALLGWTGSRQFERDLRRFARHERKMLLDRHALYDKTKKIFLPAKTEEDIFAHLGLDYIPPWQRNA

SEQ ID NO: 349 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 350 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDITAAVCKAEADAIGQIVEETVRGIAPDAIVTLTGGFRRGKEIGHDVDFLITTPEMGKEQLLPRVINLLEKKGLLLYYDLVESTFDKTRLPCRKFEAMDHFQQCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 351 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRMGFHTLEEVQADKAIHFTKMQKAGFLYYDDISAAVCKAEADAIGQIVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKRIFLPAKTEEDIFAHLGLDYIPPWQRNA

SEQ ID NO: 352 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPDVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 353 - protein, 362 aa, Artificial Sequence
  Modified TdT Sequence
MENLYFQGTVSQYACQRRTTMENHNQIFTDAFAILAENAEFNESEGPCVAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGREQLLPRLINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 354 - protein, 362 aa, Artificial Sequence
  Modified TdT Sequence
MENLYFQGTVSQYACQRRTTMENHNQIFTDAFAILAENAEFNESEGPAVAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAILTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 355 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRMGFHSLEEVQADKAIQFTKMQKAGFLYYDDISAAVCKAEADAIGQIVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVMPPVDCFAFALLGWTGSRQFERDLRRFARHERKMLLDRHALYDKTKKIFLPAKTEEDIFAHLGLDYIPPWQRNA

SEQ ID NO: 356 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIQFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 357 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQRAGFLYYDDISAAVCKAEADAIGQIVEETVRLIAPDAIVTLTGGFRRGKEIGHDVDFLITTPEMGKEQLLPKVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEEIFAHLGLDYIPPWQRNA

SEQ ID NO: 358 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQSKAVIEDILEYGQCSKVQDVLCDDRYQTIKLFTSVFGVGLKTAEKWYRKGFHSLEEVQADKAIHFTKMQRAGFLYYDDISAAVCKAEADAIGQIVEETVRLIAPDAIVTLTGGFRRGKECGHDVDFLITTPEMGKEQLLPKIINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 359 - protein, 362 aa, Artificial Sequence
  Modified TdT Sequence
MENLYFQGTVSQYACQRRTTMENHNQVFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRKIAPDAIVTLTGGFRRGKEIGHDVDFLITTPEMGKEQLLPKVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDRTKKIFLPAKTEEDIFAHLGLDYIPPWQRNA

SEQ ID NO: 360 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGEQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVHLIAPDAIVTLTGGFRRGKECGHDVDFLITTPEMGKEQLLPDVINLLEKKGLLLYYDLVESTFDKTRLPCRKFEAMDHFQKCFAIIKLEKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 361 - protein, 362 aa, Artificial Sequence
  Modified TdT Sequence
MENLYFQGTVSQYACQRRTTMENHNQIFTDAFAILAENAEFRESEGPALAFRRAASLLKSLPHAISSSKDLEGLPCLGDQTKAVIEDILEYGQCSKVQDVLCDDRYQTIKLFTSVFGVGLKTAEKWYRKGFHTLEEVQADKAIQFTKMQRAGFLYYDDISAAVCKAEADAIGQIVEETVRLIAPDAIVTLTGGFRRGKEIGHDVDFLITTPEMGKEQLLPKVINLLEKKGLLLYYDLVESTFDKTRLPCRKFEAMDHFQKCFAIIKLKKELADGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 362 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGREQLLPKVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 363 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEDLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELADGRVQKDWKAIRVDFVMPPVDNFAFALLGWTGSRQFERDLRRFARHERKMLLDRHALYDKTKRIFLPAKTEEDIFAHLGLDYIPPWQRNA

SEQ ID NO: 364 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHTLEEVQADKAIQFTKMQKAGFLYYDDISAAVCKAEADAIGQIVEETVRLIAPDAIVTLTGGFRRGKEIGHDVDFLITTPEMGKEQLLPKVIDLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 365 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADRAIQFTKMQKAGFLYYDDISAAVCKAEADAIGQIVEETVRLIAPDAIVTLTGGFRRGKEIGHDVDFLITTPEMGKEQLLPKVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEEIFAHLGLEYIPPWQRNA

SEQ ID NO: 366 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQRAGFLYYDDISAAVCKAEADAIGQIVEETVRLIAPDAIVTLTGGFRRGKEIGHDVDFLITTPEMGREQLLPDVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 367 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKGVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEQGKEQLLPKVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKSEEDIFAHLGLDYIPPWQRNA

SEQ ID NO: 368 - protein, 362 aa, Artificial Sequence
  Modified TdT Sequence
MENLYFQGTVSQYACQRRTTMENHNQVFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDALVTLTGGFRRGKEIGHDVDFLITTPEMGKEQLLPKLIDLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 369 - protein, 362 aa, Artificial Sequence
  Modified TdT Sequence
MENLYFQGTVSQYACQRRTTMENHNQIFTDAFAILAENAEFNENEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQRAGFLYYDDISAAVCKAEADAIGQIVEETVRLIAPDAIVTLTGGFRRGKEIGHDVDFLITTPEMGKEQLLPRVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 370 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQRAGFLYYDDISAAVCKAEADAIGQIVEETVRLIAPDAIVTLTGGFRRGKEIGHDVDFLITTPEMGKEQLLPKVIDLLEQKGLLLYYDLVESTFDKTRLPCRKFEAMDHFQKCFAIIKLKKELADGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 371 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKSIQFTKMQKAGFLYYDDISAAVCKAEADAIGHIVEETVRLIAPDAIVTLTGGFRRGKECGHDVDFLITTPEMGKEQLLPDVINLLEKKGLLLYYDLVESTFDKTRLPCRKFEAMDHFQKCFAIIKLKKERAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 372 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSLKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFIITTPEMGKEQLLPKVINLLEKKGLLLYYDLVESTFDKTRLPCRKFEAMDHFQKCFAIIKLKKELAAGRVQKDWKAIRVDFVMPPADNFAFALLGWTGSRQFERDLRRFARHERKMLLDRHALYDKTKKIFLPAKTEEDIFAHLGLDYIPPWQRNA

SEQ ID NO: 373 - protein, 362 aa, Artificial Sequence
  Modified TdT Sequence
MENLYFQGTVSQYACQRRTTMENHNQIFTDAFAILAERAEFNESESPCLAFRRAASLLKSLPHAISSSKDLEGLPCLGDQTKAVIEDILEYGQCSKVQDVLCDDRYQTIKLFTSVFGVGLKTAEKWYRKGFHTLEEVQADKAIHFTKMQKAGFLYYDDISAAVCKAEADAIGQIVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 374 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQANKAIHFTKMQKAGFLYYDDISAAVCKAEADAIGQIVEETVRLIAPDAIVTLTGGFRRGKECGHDVDFLITTPEAGKEQLLPKVINLWEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 375 - protein, 362 aa, Artificial Sequence
  Modified TdT Sequence
MENLYFQGTVSQYACQRRTTMENHNQIFTDAFAILAENAEFNESEGPALAFLRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEMGKEQLLPKVINLLEQKGLLLYYDLVESTFDITRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 376 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQRAGFLYYDDISAAVCKAEADAIGQIVEETVRLIAPDAIVTLTGGFRRGKEIGHDVDFLITTPEMGKEQLLPKVINLLEKKGLLLYYHLVESTFDKTRLPCRKFEAMDHFQKCWAIIKLKKELAAGRVQKDWKAIRVDFVMPPVDNFAFALLGWTGSRQFERDLRRFARHERKMLLDRHALYDRTKKIFLPAKTEEDIFAHLGLDYIPPWQRNA

SEQ ID NO: 377 - protein, 362 aa, Artificial Sequence
  Modified TdT Sequence
MENLYFQGTVSQYACQRRTTMENHNQIFTDAFAILAENAEFRESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEMGKEQLLPKVIDLLEKKGLLLYYDLVESTFDKTRLPCRKFEAMDHFQKCFAILKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 378 - protein, 362 aa, Artificial Sequence
  Modified TdT Sequence
MENLYFQGTVSQYACQRRTTMENHNQIFTDAFAILAENAEFNENEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRKIAPDAIVTLTGGFRRGKECGHDVDFLITTPEMGKEQLLPKVMNLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 379 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQRAGFLYYDDISAAVCKAEADAIGQIVEETVRLIAPDAIVALTGGFRRGKEIGHDVDFLITTPEMGKEQLLPRLINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 380 - protein, 362 aa, Artificial Sequence
  Modified TdT Sequence
MENLYFQGTVSQYACQRRTTMENHNQLFTDAFAILAENAEFNESEGPALAFRRAASLLKSLPHAISSSKDLEGLPCLGDQTKAVIEEILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPDVINLLEKKGLLLYYDLVESTFDKTRLPCRRFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 381 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISRSKDLEGLPCLGDQTKAVIEDILEYGQCSKVQDVLCDDRYQTIKQFTSVFGVGLKTAEKWYRKGFHSLEEVQADKAIHFSKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 382 - protein, 362 aa, Artificial Sequence
  Modified TdT Sequence
MENLYFQGTVSQYACQRRTTMENHNQIFTDAFAILAENAEFNESEGPALAFLRAASLLKSLPHAISSLKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEMGKEQLLPKVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKSEEDIFAHLGLDYIPPWQRNA

SEQ ID NO: 383 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSLKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRKIAPDAIVTLTGGFRRGKECGHDVDFIITTPEMGKEQLLPDVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLEYIPPWQRNA

SEQ ID NO: 384 - protein, 362 aa, Artificial Sequence
  Modified TdT Sequence
MENLYFQGTVSQYACQRRTTMENHNQIFTDAFAILAENAEFNENEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGCIVEETVHLIAPDAIVTLTGGFRRGKEIGHDVDFLITTPEMGKEQLLPKVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEEIFAHLGLDYIPPWQRNA

SEQ ID NO: 385 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEMGKEQLLPKLINLLEQKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 386 - protein, 362 aa, Artificial Sequence
  Modified TdT Sequence
MENLYFQGTVSQYACQRRTTMENHNQIFTDAFAILAENAEFNESEGPCLAFRRAASLLKSLPHAIISSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDNFQKCFAIIKLKKELAAGRVQKDWKAIRVDFVMPPVDNYAFALLGWTGSRQFERDLRRFARHERKMLLDRHALYDKTKKIFLPAKTEEDIFAHLGLDYIPPWQRNA

SEQ ID NO: 387 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKGVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEQGKEQLLPDVINLLEKKELLLYYDLVESTFDKTRLPCRKFEAMDHFQKCFAIIKLKKELAAGRVQKDWKAIRVDFVMPPIDNFAFTLLGWTGSRQFERDLRRFARHERKMLLDRHALYDKTKKIFLPAKTEEDIFAHLGLDYIPPWQRNA

SEQ ID NO: 388 - protein, 362 aa, Artificial Sequence
  Modified TdT Sequence
MENLYFQGTVSQYACQRRTTMENRNQIFTDAFAILAENAEFNENEGPALAFRRAASLLKSLPHAISSSKDLEGLPCLGDQTKAVIEDILEYGQCSKVQEVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPDVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 389 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISRSKDLEGLPCLGDQTKCVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKNCGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 390 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKQFTSVFGVGLKTAEKWYRKGFHSLEEVQADKAIHFTKMQKAGFLYYDDISAAVCKAEADAIGQIVEETVRLITPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNYAFALLGWTGSRQFERDLRRFARHERKMLLDRHALYDKTKKIFLPAKTEEDIFAHLGLDYIPPWQRNA

SEQ ID NO: 391 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEMGKEQLLPKVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 392 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKSEEDIFAHLGLDYIPPWQRNA

SEQ ID NO: 393 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDIYEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPDVMNLLEKKGLLLYYDLVESTFDKTRLPCRKFEAMDHFQKCFAIIRLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 394 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRMGFHTLEEVQADKAIQFTKMQKAGFLYYDDISAAVCKAEADAIGQIVEETVRLIAPDAIVTLTGGFRRGKEIGHDVDFLITTPEMGKEQLLPKVINLLEQKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDRTKKIFLPAKTEEDIFAHLGLDYIPPWQRNA

SEQ ID NO: 395 - protein, 362 aa, Artificial Sequence
  Modified TdT Sequence
MENLYFQGTVSQYACQRRTTMENHNQIFTDAFAILAENAEFNENEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRKIAPDAIVTLTGGFRRGKEIGHDVDFLITTPEAGKEQLLPKVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 396 - protein, 362 aa, Artificial Sequence
  Modified TdT Sequence
MENLYFQGTVSQYACQRRTTMENHNQIFTDAFAILAERAEFNESEGPCLAFRRAASLLKSLPHAISSSKDLEGLPCLGDQTKAVIEDILEYGQCSKVQDVLCDDRYKTIKLFTSVFGVGLKTAEKWYRKGFHSLEEVQADKAIHFTKMQKAGFLYYDDISAAVCKAEADAIGQVVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 397 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADRAIHFTKMQKAGFLYYDDISAAVCKAEADAIGQIVEETVRLIAPDAIVTLTGGFRRGKEIGHDVDFLITTPEMGKEQLLPKLINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 398 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHTLEEVQADKAIQFTKMQKAGFLYYDDISAAVCKAEADAIGQIVEETVRLIAPDAIVTLTGGFRRGKEIGHDVDFLITTPEMGKEQLLPDVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEEIFAHLGLDYIPPWQRNA

SEQ ID NO: 399 - protein, 362 aa, Artificial Sequence
  Modified TdT Sequence
MENLYFQGTVSQYACQRRTTMENHNQIFTDAFAILAENAEFNENEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEMGKEQLLPKVIDLLEQKGLLLYYDLVESTFDKTRLPCRKFEAMDHFQKCFAIIKLKKEQAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 400 - protein, 362 aa, Artificial Sequence
  Modified TdT Sequence
MENLYFQGTVSQYACQRRTTMENHNQIFTDAFAILAENAEFNESEGPCLAFLRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVLPPIDNFAFALLGWTGSRQFERDLRRFARHERKMLLDRHALYDKTKKIFLPAKTEEDIFAHLGLDYIPPWQRNA

SEQ ID NO: 401 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDIYEYGQCSKVQDVLCDDRYQTIKLFTSVFGVGLKTAEKWYRKGFHSLEEVQADRAIQFTKMQKAGFLYYDDISAAVCKAEADAIGQIVEETVRLIAPDAIVTLTGGFRRGKECGHDVDFLITTAEMGKEQLLPDVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLEYIPPWQRNA

SEQ ID NO: 402 - protein, 362 aa, Artificial Sequence
  Modified TdT Sequence
MENLYFQGTVSQYACQRRTTMENHNQIFTDAFAILAENAEFNESEGPCLAFLRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQRAGFLYYDDISAAVCKAEADAIGQIVEETVRLIAPDAIVTLTGGFRRGKEIGHDVDFLITTPEMGKEQLLPKVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 403 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISCSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVIRLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 404 - protein, 362 aa, Artificial Sequence
  Modified TdT Sequence
MENLYFQGTVSQYACQRRTTMENHNQIFTDAFAILAENAEFNESEGPCLAFLRAASLLKSLPHAISSSKDLEGLPCLGDQTKAVIEDILEYGQCSKAQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEQKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 405 - protein, 362 aa, Artificial Sequence
  Modified TdT Sequence
MENLYFQGTVSQYACQRRTTMENHNQIFTDAFAILAENAEFNESEGPALAFRRAASLLKSLPHAILSSKDLEGLPCLGDQTKGVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDALVTLTGGFRRGKECGHDVDFLITTPEMGKEQLLPDVINLLEKKGLLLYYDLVESTFDKTRLPCRKFEAMDHFQKCFAIIKLKKERAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 406 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGEQTKAVIEDILEYGQCSKVQDVLCDDRYQTIKLFTSVFGVGLKTAEKWYRKGFHSLEEVQADKSIQFTKMQKAGFLYYDDISAAVCKAEADAIGQIVEETVRLIAPDAIVTLTGGFRRGKECGHDVDFLITTPEMGKEQLLPDVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 407 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEMGREQLLPRVINLLEQKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 408 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGCIVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEEIFAHLGLDYIPPWQRNA

SEQ ID NO: 409 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLLEKKGLLLYYDLVESTFDKTRLPCRKFEAMDNFQKCFAIIKLKAELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 410 - protein, 362 aa, Artificial Sequence
  Modified TdT Sequence
MENLYFQGTVSQYACQRRTTMENHNQIFTDAFAILAENAEFNENEGPALAFRRAASLLKSLPHAILSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPDVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKRIFLPAKTEEDIFAHLGLDYIPPWQRNA

SEQ ID NO: 411 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRAIAPDAIVTLTGGFRRAKECGHDVDFLITTPEMGKEQLLPDVINLLEKKGLLLYYHLVESTFDKTRLPCRKFEAMDHFQKCFAIIKLNKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 412 - protein, 362 aa, Artificial Sequence
  Modified TdT Sequence
MENLYFQGTVSQYACQRRTTMENHNQIFTDAFAILAENAEFNESEGPCVAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGCIVEETVRLIAPDAIVTLTGGFRRGKEIGHDVDFLITTPEMGKEQLLPKVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 413 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYKTIKLFTSVFGVGLKTAEKWYRKGFHSLEEVQADKAIHFTKMQKAGFLYYDDISAAVCKAEADAIGQIVEETVRGIAPDAIVTLTGGFRRGKEIGHDVDFLITTPEMGKEQLLPKVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 414 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPKVIDLWEKKGLLLYYDLVESTFDKTRLPCRKFEAMDHFQKCFAIIKLKKQLAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 415 - protein, 362 aa, Artificial Sequence
  Modified TdT Sequence
MENLYFQGTVSQYACQRRTTMENHNQIFTDAFAILAERAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEAGKEQLLPRVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 416 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEAGKEQLLPKVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEEIFAHLGLDYIPPWQRNA

SEQ ID NO: 417 - protein, 362 aa, Artificial Sequence
  Modified TdT Sequence
MENLYFQGTVSQYACQRRTTMENHNKIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGCIVEETVRLIAPDAIVTLTGGFRRGKEIGHDVDFLITTPEMGKEQLLPRVINLLEQKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 418 - protein, 362 aa, Artificial Sequence
  Modified TdT Sequence
MENLYFQGTVSQYACQRRTTMENHNQIFTDAFAILAENAEFNENEVPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQVVEETVRLIAPDAIVTLTGGFRRGKEIGHDVDFLITTPEMGKEQLLPKLINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 419 - protein, 362 aa, Artificial Sequence
  Modified TdT Sequence
MENLYFQGTVSQYACQRRTTMENHNQIFTDAFAILAERAEFNENEGPCVAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 420 - protein, 362 aa, Artificial Sequence
  Modified TdT Sequence
MENLYFQGTVSQYACQRRTTMENHNQIFTDAFAILAENAEFNESESPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRVINLLEKKGLLLYYDLVESTFDKTRLPCRKFEAMDHFQQCFAIIKLKKELAAGRVQKDWKAIRVDFVMPPVDNFAFALLGWTGSRQFERDLRRFARHERKMLLDRHALYDKTKKIFLPAKTEEEIFAHLGLDYIPPWQRNA

SEQ ID NO: 421 - protein, 362 aa, Artificial Sequence
  Modified TdT Sequence
MENLYFQGTVSQYACQRRTTMENHNQIFTDAFAILAENAEFNESEGPCLAFLRAASLLKSLPHAISSSKDLEGLPCLGDQTKAVIEDILEYGQCSKVQDVLCDDRYQTIKLFTSVFGVGLKTAEKWYRKGFHSFEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKQLAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 422 - protein, 362 aa, Artificial Sequence
  Modified TdT Sequence
MENLYFQGTVSQYACQRRTTMENHNQIFTDAFAILAENAEFNESEGPALAFRRAASLLKSLPHTISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEQGKEQLLPDVINLLEKKGLLLYYDLVESTFDKTRLPCRKFEAMDHFQKCFAIIKLKKELAAGRVQKDWKAIRVDFVMPPADNFAFALLGWTGSRQFERDLRRFARHERKMLLDRHALYDKTKKIFLPAKTEEDIFAHLGLDYIPPWQRNA

SEQ ID NO: 423 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRVINLWEKKGLLLYYDLVESTFDKTRLPCRKFEAMDHFQQCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 424 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPGMGKEQLLPKVINLWEKKGLLLYYDLVESTFDKLRLPCRKFEAMDHFQKCFAIIKLKKELAAGRVQKDWKAIRVDFVMPPVDNFAFALLGWTGSRQFERDLRRFARHERRMLLDRHALYDKTKKIFLPAKTEEDIFAHLGLDYIPPWQRNA

SEQ ID NO: 425 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRGIAPDAIVTLTGGFRRGKEIGHDVDFLITTPEMGKEQLLPRVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 426 - protein, 362 aa, Artificial Sequence
  Modified TdT Sequence
MENLYFQGTVSQYACQRRTTMENHNQIFTDAFAILAENAEFNESEGPALAFLRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEAGKEQLLPKVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEEIFAHLGLDYIPPWQRNA

SEQ ID NO: 427 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEEIYEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPKVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 428 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELADGRVQKDWKAIRVDFVLPPVDNFAFALLGWTGSRQFERDLRRFARHERRMLLDRHALYDKTKKIFLPAKTEEDIFAHLGLDYIPPWQRNA

SEQ ID NO: 429 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYKTIKLFTSVFGVGPKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYVPPWQRNA

SEQ ID NO: 430 - protein, 362 aa, Artificial Sequence
  Modified TdT Sequence
MENLYFQGTVSQYACQRRTTMENHNQIFTDAFAILAENAEFNENEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQRAGFLYYDDISAAVCKAEADAIGQIVEETVRLIAPDAIVTLTGGFRRGKECGHDVDFLITTPEMGKEQLLPKVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKRIFLPAKTEEDIFAHLGLDYIPPWQRNA

SEQ ID NO: 431 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDRTKAVIEDILEYGQCSKVQDVLCDDRYQTIKLFTSVFGVGLKTAEKWYRMGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKAELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 432 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRLINLLEKKGLLLYYDLVESTFDKTRLPCRKFEAMDHFQKCFAIIKLKQELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 433 - protein, 362 aa, Artificial Sequence
  Modified TdT Sequence
MENLYFQGTVSQYACQRRTTMENHNQIFTDAFAILAENAEFNESEGPALAFRRAASLLKSLPHTISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRKIAPDAIVTLTGGFRRGKECGHDVDFLITTPEMGKEQLLPDVINLLEKKGLLLYYDLIESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 434 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVALTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYVPPWQRNA

SEQ ID NO: 435 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISCSKDLEGLPCLGDQTKAVIEDILEYGQCSKVQDVLCDDRYQTIKLFTSVFGVGLKTAEKWYRKGFHSLEEVQAEKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKRKKIFLPAKTEEDIFAHLGLDYIPPWQRNA

SEQ ID NO: 436 - protein, 362 aa, Artificial Sequence
  Modified TdT Sequence
MENLYFQGTVSQYACQRRTTLENHNQIFTDAFAILAENAEFNESEGPALAFRRAASLLKSLPHAISSSKDLEGLPCLGDQTKAVIEEILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPDVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 437 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVMPPVDCFAFALLGWTGSRQFERDLRRFARHERKMLLDRHALYDKTKRIFLPAKTEEDIFAHLGLDYIPPWQRNA

SEQ ID NO: 438 - protein, 362 aa, Artificial Sequence
  Modified TdT Sequence
MENLYFQGTVSQYACQRRTTMENHNKIFTDAFAILAENAEFNESEGPCLAFRRAASLLKSLPHAISSSKDLEGLPCLGDQTKAVIEDILEYGQCSKVQDVLCDDRYKTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 439 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEEILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDALVTLTGGFRRGKEIGHDVDFLITTPEMGKEQLLPKVINLLEKKGLLLYYDLIESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 440 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRMGFHSLEEVQADKAIQFTKMQKAGFLYYDDISAAVCKAEADAIGQIVEETVRLIAPDAIVTLTGGFRRGKEIGHDVDFLITTPEMGKEQLLPKLINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEEIFAHLGLDYIPPWQRNA

SEQ ID NO: 441 - protein, 362 aa, Artificial Sequence
  Modified TdT Sequence
MENLYFQGTVSQYACQRRTTMENHNQIFTDAFAILAENAEFNENEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVLPPVDNFAFALLGWTGSRQFERDLRRFARHERKMLLDRHALYDKTKKIFLPAKTEEDIFAHLGLDYIPPWQRNA

SEQ ID NO: 442 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEEILEYGQCSKVQEVLCDDRYQTIKLFTSVFGVGLKTAEKWYRKGFHSLEEVQADKAIQFTKMQKAGFLYYDDISAAVCKAEADAIGQIVEETVRKIAPDAIVTLTGGFRRGKECGHDVDFLITTPEMGKEQLLPDVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 443 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHTLEEVQADKAIHFTKMQKAGFLYYDDISAAVCKAEADAIGQIVEETVRGIAPDAIVTLTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDRTKKIFLPAKTEEDIFAHLGLDYIPPWQRNA

SEQ ID NO: 444 - protein, 362 aa, Artificial Sequence
  Modified TdT Sequence
MENLYFQGTVSQYACQRRTTMENHNQIFTDAFAILAENAEFNENEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFIITTPEMGKEQLLPKVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDRTKKIFLPAKTEEEIFAHLGLDYIPPWQRNA

SEQ ID NO: 445 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGCVVEETVRLIAPDAIVTLTGGFRRGKEIGHDVDFLITTPEQGKEQLLPKVINLLEQKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 446 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEMGKEQLLPKVINLLEKKGLLLFYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEEIFAHLGLDYIPPWQRNA

SEQ ID NO: 447 - protein, 362 aa, Artificial Sequence
  Modified TdT Sequence
MENLYFQGTVSQYACQRRTTMENHNQIFTDAFAILAENAEFNESEGPSLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEMGKEQLLPKVINLLEKKGLLLYYDLVESTFDKTRLPCRKFEAMDHFQKCFAILKLKKELAAGRVQKDWKAIRVDFVMPPVDNFAFALLGWTGSRQFERDLRRFARHERKMLLDRHALYDKTKKIFLPAKSEEDIFAHLGLDYIPPWQRNA

SEQ ID NO: 448 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEDVQADKAIHFTKMQKAGFLYYDDISAAVCRAEADAIGQIVEETVRLIAPDAIVTLTGGFRRGKECGHDVDFLITTPEMGKEQLLPKVIRLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 449 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 450 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDIYEYGQCSKVQDVLCDDRYQTIKLFTSVFGVGLKTAEKWYRKGFHSLEEVQADKAIQFTKMQKAGFLYYDDISAAVCKAEADAIGQIVEETVHLIAPDAIVTLTGGFRRGKECGHDVDFLITTPEKGKEQLLPDVINLLEKKGLLLYYDLVESTFDKTRLPCRKFEAMDHFQKCFAIIKLKKELAAGRVQKDWKAIRVDFVMPPADNFAFALLGWTGSRQFERDLRRFARHERKMLLDRHALYDKTKKIFLPAKTEEDIFAHLGLDYIPPWQRNA

SEQ ID NO: 451 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGPKTAEKWYRKGFHSLEEVQADKAIHFTKMQKAGFLYYDDISAAVCKAEADAIGQIVEETVRLIAPDAIVTLTGGFRRGKEIGHDVDFLITTPEMGREQLLPRVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 452 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCRAEADAIGQIVEETVRLIAPDAIVTLTGGFRRGKEIGHDVDFLITTPEMGKEQLLPKVINLWEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 453 - protein, 362 aa, Artificial Sequence
  Modified TdT Sequence
MENLYFQGTVSQYACQRRTTMENRNQIFTDAFAILAENAEFNESEGPALAFRRAASLLKSLPHAISSSKDLEGLPCLGDQTKGVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFIITTPEMGKEQLLPDVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 454 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVHLIAPDAIVTLTGGFRRGKEIGHDVDFLITTPEAGKEQLLPKVINLLEKKGLLLYYDLVESTFDKTRLPCRKFEAMDHFQKCFAIIKLKKELADGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 455 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDALVTLTGGFRRGKEIGHDVDFIITTPEMGREQLLPKVINLLEQKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 456 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFSKMQKAGFLYYDDISAAVCKAEADAIGQIVEETVRLITPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 457 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYKTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEMGKEQLLPKVINLLEKKGLLLYYDLVESTFDKTRLPCRKFEAMDHFQKCFAIIKLKKELADGRVQKDWKAIRVDFVMPPVDNFAFALLGWTGSRQFERDLRRFARHERKMLLDRHALYDKTKKIFLPAKTEEEIFAHLGLDYIPPWQRNA

SEQ ID NO: 458 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGRIVEETVRLIAPDAIVTLTGGFRRGKECGHDVDFLITTPEMGKEQLLPKVINLWEKKGLLLYYDLVESTFDKSRLPCRKFEAMDHFQKCFAIIKLKKELAAGRVQKDWKAIRVDFVLPPVDNFAFALLGWTGSRQFERDLRRFARHERKMLLDRHALYDKTKKIFLPAKTEEDIFAHLGLDYIPPWQRNA

SEQ ID NO: 459 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKAQDVLCDDRYQTIKLFTSVFGVGLKTAEKWYRKGFHSLEEVQADKAIHFTKMQKAGFLYYDDISAAVCKAEADAIGQIVEETVRLITPDAIVTLTGGFRRGKECGHDVDFLITTPEMGKEQLLPKIINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 460 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSLKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDALVTLTGGFRRGKECGHDVDFLITTPEKGKEQLLPDVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 461 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRAKECGHDVDFLITTPEQGKEQLLPDVINLLEKKGLLLYYDLVESTFDKTRLPCRKFEAMDHFQKCFAIIKLKKERAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 462 - protein, 362 aa, Artificial Sequence
  Modified TdT Sequence
MENLYFQGTVSQYACQRRTTTENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKSIQFTKMQKAGFLYYDDISAAVCKAEADAIGQIVEETVRLIAPDAIVTLTGGFRRGKECGHDVDFLITTPEMGKEQLLPDVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLEYIPPWQRNA

SEQ ID NO: 463 - protein, 362 aa, Artificial Sequence
  Modified TdT Sequence
MENLYFQGTVSQYACQRRTTTENHNQIFTDAFAILAENAEFNESEGPALAFRRAASLLKSLPHAILSSKDLEGLPCLGDQTKAVIEEILEYGQCSKVQDVLCDDRYQTIKLFTSVFGVGLKTAEKWYRKGFHSLEEVQADKAIQFTKMQKAGFLYYDDISAAVCKAEADAIGHIVEETVRLIAPDAIVTLTGGFRRGKECGHDVDFLITTPEMGKEQLLPDVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 464 - protein, 362 aa, Artificial Sequence
  Modified TdT Sequence
MENLYFQGTVSQYACQRRTTMENHNQIFTDAFAILAENAEFNESEGPSLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQRAGFLYYDDISAAVCKAEADAIGQIVEETVRLIAPDAIVTLTGGFRRGKEIGHDVDFLITTPEMGKEQLLPKLINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 465 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQANKAIHFTKMQKAGFLYYDDISAAVCKAEADAIGQIVEETVRLIAPDAIVTLTGGFRRGKECGHDVDFLITTPEMGKEQLLPKVVNLWEKKGLLLYYDLVESTFDKTRLPCRKFEAMDHFQKCFAIIKLKKELAAGRVQKDWKAIRVDFVMPPVDNYAFALLGWTGSRQFERDLRRFARHERKMLLDRHALYDKTKKIFLPAKTEEDIFAHLGLDYIPPWQRNA

SEQ ID NO: 466 - protein, 362 aa, Artificial Sequence
  Modified TdT Sequence
MENLYFQGTVSQYACQRRTTMENHNQIFTDAFAILAENAEFNESEGPCVAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPRVINLLEKKGLLLYYDLVESTFDKTRLPCRKFEAMDHFQKCFAIIKLKKELAAGRVQKDWKAIRVDFVMPPVDCFAFALLGWTGSRQFERDLRRFARHERKMLLDRHALYDKTKKIFLPAKTEEDIFAHLGLDYIPPWQRNA

SEQ ID NO: 467 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDIYEYGQCSKVQDVLCDDRYQTIKLFTSVFGVGLKTAEKWYRKGFHSLEEVQADKAIHFTKMQKAGFLYYDDISAAVCKAEADAIGQIVEETVRAIAPDAIVTLTGGFRRGKECGHDVDFLITTPEMGKEQLLPDVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 468 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDIIEYGQCSKVQDVLCDDRYQTIKLFTSVFGVGLKTAEKWYRKGFHSLEEVQADKAIHFTKMQKAGFLYYDDISAAVCRAEADAIGQIVEETVRLIAPDAIVTLTGGFRRGKECGHDVDFLITTPEMGKEQLLPKVINLWEKKGLLLYYDLVESTFDKLRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 469 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHTLEEVQADKAIHFTKMQKAGFLYYDDITAAVCKAEADAIGQIVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 470 - protein, 362 aa, Artificial Sequence
  Modified TdT Sequence
MENLYFQGTVSQYACQRRTTMENHNQIFTDAFAILAENAEFNENEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDRTKKIFLPAKTEEDIFAHLGLDYVPPWQRNA

SEQ ID NO: 471 - protein, 362 aa, Artificial Sequence
  Modified TdT Sequence
MENLYFQGTVSQYACQRRTTMENHNQIFTDAFAILAENAEFNENEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQRAGFLYYDDISAAVCKAEADAIGQIVEETVRLIAPDAIVTLTGGFRRGKECGHDVDFLITTPEMGKEQLLPKVIRLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 472 - protein, 362 aa, Artificial Sequence
  Modified TdT Sequence
MENLYFQGTVSQYACQRRTTMENHNQVFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEMGKEQLLPKVINLLEKKGLLLYYDLVESTFDKTRLPCRKFEAMDHFQKCFAIIKLKKERADGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 473 - protein, 362 aa, Artificial Sequence
  Modified TdT Sequence
MENLYFQGTVSQYACQRRTTMENHNQLFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRKIAPDAIVTLTGGFRRGKECGHDVDFLITTPEMGKEQLLPDVINLLEKKGLLLYYDLVESTFDKTRLPCRKFEAMDHFQKCFAIIKLNKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 474 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCRAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELADGRVQKDWKAIRVDFVMPPVDRFAFALLGWTGSRQFERDLRRFARHERKMLLDRHALYDKTKKIFLPAKTEEDIFAHLGLDYIPPWQRNA

SEQ ID NO: 475 - protein, 362 aa, Artificial Sequence
  Modified TdT Sequence
MENLYFQGTVSQYACQRRTTMENHNQIFTDAFAILAENAEFNESEVPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPKVINLLEKKGLLLYYDLVESTFDKARLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 476 - protein, 362 aa, Artificial Sequence
  Modified TdT Sequence
MENLYFQGTVSQYACQRRTTLENHNQIFTDAFAILAENAEFNESEGPALAFRRAASLLKSLPHAISSSKDLEGLPCLGEQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPKVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 477 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKGVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPDLINLLEKKGLLLYYDLVESTFDKTRLPCRRFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 478 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQEVLCDDRYQTIKLFTSVFGVGLKTAEKWYRKGFHSLEEVQADKAIHFTKMQKAGFLYYDDISAAVCKAEADAIGQIVEETVRLIAPDALVTLTGGFRRGKECGHDVDFLITTPEMGKEQLLPDVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 479 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQEVLCDDRYQTIKLFTSVFGVGLKTAEKWYRKGFHSLEEVQADKAIQFTKMQKAGFLYYDDISAAVCKAEADAIGQIVEETVRLMAPDAIVTLTGGFRRGKECGHDVDFLITTPEMGKEQLLPDVINLLEKKGLLLYYDLVESTFDKTRLPCRKFEAMDHFQKCFAIIKLEKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 480 - protein, 362 aa, Artificial Sequence
  Modified TdT Sequence
MENLYFQGTVSQYACQRRTTMENHNQIFTDAFAILAENAEFNESEGPALAFRRAASLLKSLPHTISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKSCGHDVDFLITTPEMGKEQLLPDVINLLEKKGLLLYYDLVESTFDKTRLPCRKFEAMDHFQKCFAIIKLKKELAAGRVQKDWKAIRVDFVMPPIDNFAFTLLGWTGSRQFERDLRRFARHERKMLLDRHALYDKTKKIFLPAKTEEDIFAHLGLDYIPPWQRNA

SEQ ID NO: 481 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQVVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELADGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 482 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILECGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEQKGLLLYYDLVESTFDKTRLPCRKFEAMDHFQKCFAIIKLKKELAAGRVQKDWKAIRVDFVMPPVDCFAFALLGWTGSRQFERDLRRFARHERKMLLDRHALYDKTKKIFLPAKTEEDIFAHLGLDYIPPWQRNA

SEQ ID NO: 483 - protein, 362 aa, Artificial Sequence
  Modified TdT Sequence
MENLYFQGTVSQYACQRRTTMENHNQIFTDAFAILAENAEFNESEGPCVAFRRAASLLKSLPHAISSSKDLEGLPCLGDQTKAVIEDILEYGQCSKVQDVLCDDRYQTIKLFTSVFGVGLKTAEKWYRKGFHSFEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELADGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 484 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKNCGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNYAFALLGWTGSRQFERDLRRFARHERKMLLDRHALYDKTKKIFLPAKTEEDIFAHLGLDYIPPWQRNA

SEQ ID NO: 485 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFIITTPEMGKEQLLPDVINLLEKKGLLLYYDLVESTFDKTRLPSRKFEAMDHFQKCFAIIKLKKELAAGRVQKDWKAIRVDFVMPPADNFAFALLGWTGSRQFERDLRRFARHERKMLLDRHALYDKTKKIFLPAKTEEDIFAHLGLDYIPPWQRNA

SEQ ID NO: 486 - protein, 362 aa, Artificial Sequence
  Modified TdT Sequence
MENLYFQGTVSQYACQRRTTMENHNQIFTDAFAILAENAEFNESEGPALAFRRAASLLKSLPHAILSSKDLEGLPCLGDQTKAVIEDILEYGQCSKVQDVLCDDRYKTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPDVINLLEKKGLLLYYDLVESTFDKTRLPCRKFEAMDHFQKCFAIIKLKKELAAGRVQKDWKAIRVDFVMPPADNFAFALLGWTGSRQFERDLRRFARHERKMLLDRHALYDKTKKIFLPAKTEEDIFAHLGLDYIPPWQRNA

SEQ ID NO: 487 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRMGFHSLEEVQADKAIHFTKMQKAGFLYYDDISAAVCKAEADAIGQIVEETVRLIAPDAIVTLTGGFRRGKEIGHDVDFLITTPEMGKEQLLPKVINLLEKKGLLLYYDLVESTFDKARLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 488 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEAGREQLLPKVINLWEKKGLLLYYDLVESTFDKTRLPCRKFEAMDHFQKCFAIIKLKKELAAGRVQKDWKAIRVDFVMPPVDRFAFALLGWTGSRQFERDLRRFARHERKMLLDRHALYDKTKKIFLPAKTEEDIFAHLGLDYIPPWQRNA

SEQ ID NO: 489 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEEILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDALVTLTGGFRRGKECGHDVDFLITTPEQGKEQLLPDVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 490 - protein, 362 aa, Artificial Sequence
  Modified TdT Sequence
MENLYFQGTVSQYACQRRTTMENHNQVFTDAFAILAENAEFNESEGPCLAFRRAASLLKSLPHAISSSKDLEDLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEAGKEQLLPRVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 491 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKAQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKNIGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 492 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQRAGFLYYDDISAAVCKAEADAIGQIVEETVRLIAPDALVTLTGGFRRGKEIGHDVDFLITTPEMGKEQLLPKVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLEYIPPWQRNA

SEQ ID NO: 493 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKSEEEIFAHLGLDYIPPWQRNA

SEQ ID NO: 494 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEEILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPDVINLLEKKGLLLYYDLVESTFDKTRLPCRKFEAMDHFQKCFAIIKLNKELAAGRVQKDWKAIRVDFVMPPADNFAFALLGWTGSRQFERDLRRFARHERKMLLDRHALYDKTKKIFLPAKTEEDIFAHLGLDYIPPWQRNA

SEQ ID NO: 495 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEQGKEQLLPDVINLLEKKGLLLYYDLVESTFDKTRLPSRKFEAMDHFQKCFAIIKLKKELAAGCVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 496 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILECGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKAELAAGRVQKDWKAIRVDFVMPPVDNFAFALLGWTGSRQFERDLRRFARHERRMLLDRHALYDKTKKIFLPAKTEEDIFAHLGLDYIPPWQRNA

SEQ ID NO: 497 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKGVIEDILEYGQCSKVQDVLCDDRYQTIKLFTSVFGVGLKTAEKWYRMGFHSLEEVQADKAIQFTKMQRAGFLYYDDISAAVCKAEADAIGQIVEETVRLIAPDAIVTLTGGFRRGKEIGHDVDFLITTPEMGKEQLLPKVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 498 - protein, 362 aa, Artificial Sequence
  Modified TdT Sequence
MENLYFQGTVSQYACQRRTTMENHNQIFTDAFAILAENAEFNESEGPCVAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVLPPVDNFAFALLGWTGSRQFERDLRRFARHERKMLLDRHALYDKTKKIFLPAKTEEDIFAHLGLDYIDPWQRNA

SEQ ID NO: 499 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEAGKEQLLPKVINLLEKKGLLLYYDLVESTFDIARLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 500 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYKTIKLFTSVFGVGLKTAEKWYRKGFHSLEEVQADRAIQFTKMQKAGFLYYDDISAAVCKAEADAIGQIVEETVRLIAPDAIVTLTGGFRRGKECGHDVDFLITTPEMGKEQLLPKVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 501 - protein, 362 aa, Artificial Sequence
  Modified TdT Sequence
MENLYFQGTVSQYACQRRTTMENHNQVFTDAFAILAENAEFNESEGPALAFLRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 502 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRVIDLLEKKGLLLYYDLVESTFDKTRLPCRKFEAMDHFQKCFAIIKLKKELAAGRVQKDWKAIRVDFVLPPVDNFAFALLGWTGSRQFERDLRRFARHERKMLLDRHALYDKTKKIFLPAKTEEDIFAHLGLDYVPPWQRNA

SEQ ID NO: 503 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEQGKEQLLPKLINLLEKKGLLLYYDLVESTFDKTRLPCRKFEAMDHFQKCFAIIKLKKEQAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 504 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVHLIAPDAIVALTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKRIFLPAKTEEDIFAHLGLDYIPPWQRNA

SEQ ID NO: 505 - protein, 362 aa, Artificial Sequence
  Modified TdT Sequence
MENLYFQGTVSQYACQRRTTMENHNQVFTDAFAILAENAEFRESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEMGKEQLLPKVINLLEQKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEEIFAHLGLDYIPPWQRNA

SEQ ID NO: 506 - protein, 362 aa, Artificial Sequence; identical to SEQ ID NO: 391
  Modified TdT Sequence

SEQ ID NO: 507 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRMGFHSLEEVQADRAIQFTKMQKAGFLYYDDISAAVCKAEADAIGQIVEETVRLIAPDAIVTLTGGFRRGKEIGHDVDFLITTPEAGKEQLLPKVINLLEQKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 508 - protein, 362 aa, Artificial Sequence
  Modified TdT Sequence
MENLYFQGTVSQYACQRRTTMENHNQIFTDAFAILAENAEFNESESPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRVINLLEQKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIDPWQRNA

SEQ ID NO: 509 - protein, 362 aa, Artificial Sequence
  Modified TdT Sequence
MENLYFQGTVSQYACQRRTTMENHNQVFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRMGFHSLEEVQADKAIQFTKMQKAGFLYYDDISAAVCKAEADAIGQIVEETVRLIAPDAIVTLTGGFRRGKEIGHDVDFLITTPEMGKEQLLPKVINLLEKKGLLLYYDLIESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 510 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYKTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPDVINLLEKKGLLLYYDLVESTFDKTRLPCRKFEAMDHFQKCFAIIKLEKERAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 511 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRMGFHSLEEVQADKAIHFTKMQKAGFLYYDDISAAVCKAEADAIGQIVEETVRLIAPDAIVTLTGGFRRGKEIGHDVDFLITTPEMGKEQLLPRVINLWEQKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 512 - protein, 362 aa, Artificial Sequence
  Modified TdT Sequence
MENLYFQGTVSQYACQRRTTMENHNQIFTDAFAILAENAEFNESEGPCLAFRRAASLLKSLPHAIISSKDLEGLPCLGDQTKAVMEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 513 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGREQLLPKVINLWEKKGLLLYYDLVESTFDKLRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 514 - protein, 362 aa, Artificial Sequence
  Modified TdT Sequence
MENLYFQGTVSQYACQRRTTMENHNQIFTDAFAILAENAEFNENEGPALAFRRAASLLKSLPHAISSSKDLEGLPCLGDQTKGVIEDILEYGQCSKVQDVLCDDRYKTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEMGKEQLLPKVINLLEQKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 515 - protein, 362 aa, Artificial Sequence
  Modified TdT Sequence
MENLYFQGTVSQYACQRRTTMENHNQIFTDAFAILAENAEFNESEGPCLAFRRAASLLKSLPHAIISSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPGMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDRTKKIFLPAKTEEDIFAHLGLDYIPPWQRNA

SEQ ID NO: 516 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPDVMNLLEKKELLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLEYIPPWQRNA

SEQ ID NO: 517 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTAEMGKEQLLPDVINLLEKKELLLYYHLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 518 - protein, 362 aa, Artificial Sequence
  Modified TdT Sequence
MENLYFQGTVSQYACQRRTTMENNNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHTLEEVQADKAIHFTKMQKAGFLYYDDISAAVCKAEADAIGQVVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 519 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYKTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEMGKEQLLPKVINLLEKKGLLLYYDLVESTFDKTRLPCRKFEAMDHFQKCFAIIKLKKERAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 520 - protein, 362 aa, Artificial Sequence
  Modified TdT Sequence
MENLYFQGTVSQYACQRRTTMENHNQIFTDAFAILAENAEFNESEGPCLAFLRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRGIAPDAIVTLTGGFRRGKECGHDVDFLITTPGMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 521 - protein, 362 aa, Artificial Sequence
  Modified TdT Sequence
MENLYFQGTVSQYACQRRTTMENHNQIFTDAFAILAENAEFNESEGPCLAFRRAASLLKSLPHAIISSKDLEGLPCLGDQTKAVIEDIIEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKQLAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 522 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLQGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPGMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 523 - protein, 362 aa, Artificial Sequence
  Modified TdT Sequence
MENLYFQGTVSQYACQRRTTMENHNQIFTDAFAILAENAEFNESEGPCLAFRRAASVLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKNCGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 524 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYKTIKLFTSVFGVGLKTAEKWYRKGFHSLEEVQADKAIQFTKMQKAGFLYYDDISAAVCKAEADAIGQIVEETVRAIAPDAIVTLTGGFRRGKECGHDVDFLITTPEMGKEQLLPDVINLLEKKGLLLYYDLVESTFDKTRLPSRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 525 - protein, 362 aa, Artificial Sequence
  Modified TdT Sequence
MENLYFQGTVSQYACQRRTTMENHNQIFTDAFAILAENAEFNESEGPALAFRRAASLLKSLPHTISSSKDLEGLPCLGDQTKAVIEDILEYGQCSKVQEVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPDVINLLEKKELLLYYDLVESTFDKTRLPCRKFEAMDHFQKCFAIIKLKKERAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 526 - protein, 362 aa, Artificial Sequence
  Modified TdT Sequence
MENLYFQGTVSQYACQRRTTMENHNQLFTDAFAILAENAEFNESEGPALAFRRAASLLKSLPHAILSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTAEMGKEQLLPDVINLLEKKGLLLYYDLVESTFDKTRLPCRKFEAMDHFQKCFAIIKLKKELAAGRVQKDWKAIRVDFVMPPIDNFAFTLLGWTGSRQFERDLRRFARHERKMLLDRHALYDKTKKIFLPAKTEEDIFAHLGLDYIPPWQRNA

SEQ ID NO: 527 - protein, 362 aa, Artificial Sequence
  Modified TdT Sequence
MENLYFQGTVSQYACQRRTTMENHNQIFTDAFAILAENAEFNESEGPAVAFRRAASLLKSLPHAISSSKDLEGLPCLGDQTKAVIEDILEYGQCSKVQDVLCDDRYQTIKLFTSVFGVGLKTAEKWYRMGFHSLEEVQADKAIQFTKMQKAGFLYYDDISAAVCKAEADAIGQIVEETVRLIAPDAIVTLTGGFRRGKECGHDVDFLITTPEMGKEQLLPKVINLLEQKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 528 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYKTIKLFTSVFGVGLKTAEKWYRKGFHSLEEVQADKAIQFTKMQKAGFLYYDDISAAVCKAEADAIGQIVEETVRKIAPDAIVTLTGGFRRGKECGHDVDFLITTPEQGKEQLLPDVINLLEKKGLLLYYHLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 529 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEAGKEQLLPKVINLLEQKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 530 - protein, 362 aa, Artificial Sequence
  Modified TdT Sequence
MENLYFQGTVSQYACQRRTTMENHNQIFTDAFAILAENAEFNESESPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQRAGFLYYDDISAAVCKAEADAIGQVVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 531 - protein, 362 aa, Artificial Sequence
  Modified TdT Sequence
MENLYFQGTVSQYACQRRTTMENRNQIFTDAFAILAENAEFNESEGPALAFRRAASLLKSLPHAISSSKDLEGLPCLGDQTKAVIEEILEYGQCSKVQDVLCDDRYQTIKLFTSVFGVGLKTAEKWYRKGFHSLEEVQADKAIQFTKMQKAGFLYYDDISAAVCKAEADAIGQIVEETVRKIAPDAIVTLTGGFRRGKECGHDVDFLITTPEMGKEQLLPDVINLLEKKELLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 532 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPKVINLLEKKGLLLYYDLVESTFDKTRLPCRKFEAMDHFQKCFAIIKLNKERAAGRVQKDWKAIRVDFVMPPIDNFAFALLGWTGSRQFERDLRRFARHERKMLLDRHALYDKTKKIFLPAKTEEDIFAHLGLEYIPPWQRNA

SEQ ID NO: 533 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGEQTKAVIEDILEYGQCSKVQDVLCDDRYQTIKLFTSVFGVGLKTAEKWYRKGFHSLEEVQADKAIQFTKMQKAGFLYYDDISAAVCKAEADAIGHIVEETVRLIAPDAIVTLTGGFRRGKECGHDVDFLITTPEMGKEQLLPDVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKRIFLPAKTEEDIFAHLGLDYIPPWQRNA

SEQ ID NO: 534 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSFEEVQADKAIHFTKMQKAGFLYYDDISAAVCRAEADAIGQIVEETVRLIAPDAILTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 535 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYKTIKLFTSVFGVGLKTAEKWYRKGFHSLEEVQADKAIQFTKMQKAGFLYYDDISAAVCKAEADAIGQIVEETVHLMAPDALVTLTGGFRRGKECGHDVDFLITTPEMGKEQLLPDVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 536 - protein, 362 aa, Artificial Sequence
  Modified TdT Sequence
MENLYFQGTVSQYACQRRTTMENHNQIFTDAFAILAENAEFNESEGPCVAFRRAASLLKSLPHAISSSKDLQGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERRMLLDRHALYDKTKKIFLPAKTEEDIFAHLGLDYIPPWQRNA

SEQ ID NO: 537 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRVINLLEKKGLLLFYDLVESTFDKTRLPCRKFEAMDHFQKCFAIIKLKKELAAGRVQKDWKAIRVDFVMPPVDCFAFALLGWTGSRQFERDLRRFARHERKMLLDRHALYDKTKKIFLPAKTEEDIFAHLGLDYIPPWQRNA

SEQ ID NO: 538 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEDVQADKAIHFTKMQKAGFLYYDDISAAVCKAEADAIGQIVEETVRLIAPDAIVTLTGGFRRGKECGHDVDFLITTPEMGKEQLLPKVVNLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 539 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDIFEYGQCSKVQDVLCDDRYKTIKLFTSVFGVGLKTAEKWYRMGFHSLEEVQADKAIHFTKMQKAGFLYYDDISAAVCKAEADAIGQIVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELADGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 540 - protein, 362 aa, Artificial Sequence
  Modified TdT Sequence
MENLYFQGTVSQYACQRRTTMENHNQIFTDAFAILAENAEFNESEGPCVAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRVINLLEKKGLLLYYDLVESTFDKTRLPCRKFEAMDHFQQCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 541 - protein, 362 aa, Artificial Sequence
  Modified TdT Sequence
MENLYFQGTVSQYACQRRTTMENHNQIFTDAFAILAENAEFNENEGPCLAFLRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGREQLLPRVIDLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 542 - protein, 362 aa, Artificial Sequence
  Modified TdT Sequence
MENLYFQGTVSQYACQRRTTMENNNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKQELAAGRVQKDWKAIRVDFVMPPVDNFAFALLGWTGSRQFERDLRRFARHERKMLLDRHALYDKTKRIFLPAKTEEDIFAHLGLDYIPPWQRNA

SEQ ID NO: 543 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEEILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEMGKEQLLPKVINLLEKKGLLLYYHLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLEYIPPWQRNA

SEQ ID NO: 544 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEEILEYGQCSKVQDVLCDDRYQTIKLFTSVFGVGLKTAEKWYRKGFHSLEEVQADKSIQFTKMQKAGFLYYDDISAAVCKAEADAIGQIVEETVRLIAPDAIVTLTGGFRRAKECGHDVDFLITTPEMGKEQLLPDVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 545 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQRAGFLYYDDISAAVCKAEADAIGQIVEETVRLIAPDAIVTLTGGFRRGKECGHDVDFLITTPEMGKEQLLPRVINLLEQKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 546 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRMGFHSLEEVQADKAIQFTKMQKAGFLYYDDISAAVCKAEADAIGQIVEETVRLIAPDAIVTLTGGFRRGKEIGHDVDFLITTPEMGKEQLLPKVINLLEKKGLLLYYDLVESTFDITRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEEIFAHLGLDYIPPWQRNA

SEQ ID NO: 547 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRMGFHSLEEVQADKAIHFTKMQKAGFLYYDDISAAVCKAEADAIGQIVEETVRGIAPDAIVTLTGGFRRGKEIGHDVDFLITTPEAGKEQLLPRVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 548 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEDLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKQELAAGRVQKDWKAIRVDFVMPPVDCFAFALLGWTGSRQFERDLRRFARHERKMLLDRHALYDKTKKIFLPAKTEEDIFAHLGLDYIPPWQRNA

SEQ ID NO: 549 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLITPDAIVTLTGGFRRGKECGHDVDFLITTPEMGKEQLLPKVVNLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKRKKIFLPAKTEEDIFAHLGLDYIPPWQRNA

SEQ ID NO: 550 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKGVIEEILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPDVINLLEKKGLLLYYDLVESTFDKTRLPCRKFEAMDHFQKCFAIIKLKKELAAGCVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 551 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPRVINLLEKKGLLLFYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKSEEDIFAHLGLDYIPPWQRNA

SEQ ID NO: 552 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRMGFHSLEEVQADKAIHFTKMQKAGFLYYDDISAAVCKAEADAIGQIVEETVRLIAPDAIVTLTGGFRRGKECGHDVDFLITTPEAGKEQLLPKVINLWEKKGLLLYYDLVESTFDKLRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 553 - protein, 362 aa, Artificial Sequence
  Modified TdT Sequence
MENLYFQGTVSQYACQRRTTMENHNQVFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQRAGFLYYDDISAAVCKAEADAIGQIVEETVRLIAPDAIVTLTGGFRRGKEIGHDVDFLITTPEAGKEQLLPKVINLLEKKGLLLYYDLVESTFDKTRLPCRKFEAMDHFQKCFAIIKLKKELAAGRVQKDWKAIRVDFVMPPADNFAFALLGWTGSRQFERDLRRFARHERKMLLDRHALYDKTKKIFLPAKTEEDIFAHLGLDYIPPWQRNA

SEQ ID NO: 554 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLQGLPCLGDQTKAVIEDILEYGQCSKVQDVLCDDRYQTIKLFTSVFGVGLKTAEKWYRKGFHSFEEVQADKAIHFTKMQRAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 555 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPDVINLLEKKGLLLYYDLVESTFDKTRLPCRKFEAMDHFQKCFAIIKLKKERAAGRVQKDWKAIRVDFVMPPIDNFAFALLGWTGSRQFERDLRRFARHERKMLLDRHALYDKTKRIFLPAKTEEDIFAHLGLDYIPPWQRNA

SEQ ID NO: 556 - protein, 362 aa, Artificial Sequence
  Modified TdT Sequence
MENLYFQGTVSQYACQRRTTMENNNQIFTDAFAILAENAEFNESEGPCLAFLRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPRLINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 557 - protein, 362 aa, Artificial Sequence
  Modified TdT Sequence
MENLYFQGTVSQYACQRRTTMENHNQIFTDAFAILAENAEFNENEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEAGREQLLPKVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 558 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILECGQCSKVQDVLCDDRYQTIKLFTSVFGVGLKTAEKWYRKGFHSLEEVQADKAIHFTKMQKAGFLYYDDISAAVCKAEADAIGQIVEETVRGIAPDAIVTLTGGFRRGKECGHDVDFLITTPEMGKEQLLPKVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 559 - protein, 362 aa, Artificial Sequence
  Modified TdT Sequence
MENLYFQGTVSQYACQRRTTMENHNQIFTDAFAILAENAEFNESEGPALAFLRAASLLKSLPHAISSSKDLEGLPCLGDQTKAVIEDILEYGQCSKVQDVLCDDRYQTIKLFTSVFGVGLKTAEKWYRMGFHSLEEVQADKAIQFTKMQKAGFLYYDDISAAVCKAEADAIGQIVEETVRLIAPDAIVTLTGGFRRGKEIGHDVDFLITTPEMGKEQLLPKVINLLEKKGLLLYYDLVESTFDKTRLPCRKFEAMDHFQKCFAIIKLKKEQAAGRVQKDWKAIRVDFVMPPVDNFAFALLGWTGSRQFERDLRRFARHERKMLLDRHALYDKTKRIFLPAKTEEDIFAHLGLDYIPPWQRNA

SEQ ID NO: 560 - protein, 362 aa, Artificial Sequence
  Modified TdT Sequence
MENLYFQGTVSQYACQRRTTMENHNQIFTDAFAILAENAEFNESEVPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQRAGFLYYDDISAAVCKAEADAIGQIVEETVRLIAPDAIVTLTGGFRRGKEIGHDVDFLITTPEMGKEQLLPKVINLLEQKGLLLYYDLVESTFDKTRLPCRKFEAMDHFQKCFAILKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 561 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYKTIKLFTSVFGVGLKTAEKWYRKGFHSLEEVQADKAIQFTKMQKAGFLYYDDISAAVCKAEADAIGQIVEETVRKIAPDAIVTLTGGFRRGKECGHDVDFLITTPEMGKEQLLPDVINLLEKKGLLLYYDLVESTFDKTRLPCRKFEAMDHFQKCFAIIKLKKERAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 562 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSLKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPDVINLLEKKGLLLYYDLVESTFDKTRLPCRKFEAMDHFQKCFAIIKLKKELAAGRVQKDWKAIRVDFVMPPIDNFAFTLLGWTGSRQFERDLRRFARHERKMLLDRHALYDKTKKIFLPAKTEEDIFAHLGLDYIPPWQRNA

SEQ ID NO: 563 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDRTKKIFLPAKTEEDIFAHLGLDYIPPWQRNA

SEQ ID NO: 564 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLMAPDAIVTLTGGFRRGKECGHDVDFLITTPEQGKEQLLPDLINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLEYIPPWQRNA

SEQ ID NO: 565 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKSCGHDVDFIITTPEMGKEQLLPDVINLLEKKGLLLYYDLIESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 566 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEDLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRGIAPDAIVTLTGGFRRGKEIGHDVDFLITTPEMGKEQLLPRVINLLEQKGLLLYYDLVESTFDKTRLPCRKFEAMDHFQKCFAIIKLKKELAAGRVQKDWKAIRVDFVLPPVDNFAFALLGWTGSRQFERDLRRFARHERKMLLDRHALYDKTKKIFLPAKTEEDIFAHLGLDYIPPWQRNA

SEQ ID NO: 567 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGEQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPDVMNLLEKKGLLLYYDLVESTFDKTRLPCRKFEAMDHFQKCFAIIKLKKELAAGRVQKDWKAIRVDFVMPPADNFAFALLGWTGSRQFERDLRRFARHERKMLLDRHALYDKTKKIFLPAKTEEDIFAHLGLDYIPPWQRNA

SEQ ID NO: 568 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRMGFHSLEEVQADKAIQFTKMQKAGFLYYDDISAAVCKAEADAIGQIVEETVRLIAPDAIVTLTGGFRRGKEIGHDVDFLITTPEMGKEQLLPKVIDLLEKKGLLLYYELVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 569 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSFEEVQADKAIHFTKMQKAGFLYYDDISAAVCKAEADAIGQIVEETVRLIAPDAIVTLTGGFRRGKECGHDVDFLITTPEMGKEQLLPKVIDLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKRKKIFLPAKTEEDIFAHLGLDYIPPWQRNA

SEQ ID NO: 570 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHTLEEVQADKAIQFTKMQKAGFLYYDDISAAVCKAEADAIGQIVEETVHLIAPDAIVTLTGGFRRGKEIGHDVDFLITTPEQGKEQLLPKVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 571 - protein, 362 aa, Artificial Sequence; identical to SEQ ID NO: 449
  Modified TdT Sequence

SEQ ID NO: 572 - protein, 362 aa, Artificial Sequence
  Modified TdT Sequence
MENLYFQGTVSQYACQRRTTMENHNQIFTDAFAILAENAEFNENEGPALAFRRAASLLKSLPHAISSLKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEMGKEQLLPKVINLLEKKGLLLYYDLVESTFDITRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 573 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGHIVEETVRLIAPDAIVTLTGGFRRGKECGHDVDFLITTPEQGKEQLLPDVINLLEKKGLLLYYDLIESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 574 - protein, 362 aa, Artificial Sequence
  Modified TdT Sequence
MENLYFQGTVSQYACQRRTTMENHNQIFTDAFAILAENAEFNESEGPCVAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFSKMQKAGFLYYDDISAAVCKAEADAIGQIVEETVRLIAPDAIVTLTGGFRRGKECGHDVDFLITTPEMGREQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 575 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYKTIKLFTSVFGVGLKTAEKWYRKGFHSLEEVQADKAIQFTKMQKAGFLYYDDISAAVCKAEADAIGCIVEETVRLIAPDAIVTLTGGFRRGKECGHDVDFLITTPEMGKEQLLPKVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 576 - protein, 362 aa, Artificial Sequence
  Modified TdT Sequence
MENLYFQGTVSQYACQRRTTMENHNQIFTDAFAILAENAEFNESEGPCVAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELADGRVQKDWKAIRVDFVMPPVDNFAFALLGWTGSRQFERDLRRFARHERKMLLDRHALYDRTKKIFLPAKTEEDIFAHLGLDYIPPWQRNA

SEQ ID NO: 577 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEDLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKSEEDIFAHLGLDYIPPWQRNA

SEQ ID NO: 578 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISRSKDLEGLPCLGDQTKAVIEDILEYGQCSKVQDVLCDDRYQTIKLFTSVFGVGLKTAEKWYRKGFHSLEDVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 579 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDRTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAILTLTGGFRRGKECGHDVDFLITTPEMGKEQLLPKVINLWEKKGLLLYYDLVESTFDKTRLPCRKFEAMDHFQKCFAIIKLKKQLAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 580 - protein, 362 aa, Artificial Sequence
  Modified TdT Sequence
MENLYFQGTVSQYACQRRTTMENHNQIFTDAFAILAENAEFNENEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEMGKEQLLPKVINLLEKKGLLLYYHLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 581 - protein, 362 aa, Artificial Sequence
  Modified TdT Sequence
MENLYFQGTVSQYACQRRTTMENNNQIFTDAFAILAENAEFNESEGPAVAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 582 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEEILEYGQCSKVQDVLCDDRYQTIKLFTSVFGVGLKTAEKWYRKGFHSLEEVQADKAIQFTKMQKAGFLYYDDISAAVCKAEADAIGQIVEETVRKIAPDAIVTLTGGFRRGKEIGHDVDFLITTPEMGKEQLLPKVINLLEKKGLLLYYDLVESTFDKTRLPCRKFEAMDHFQKCWAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 583 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDRTKAVIEDILEYGQCSKVQDVLCDDRYQTIKQFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDNFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 584 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPDVINLLEKKGLLLYYDLIESTFDKTRLPCRKFEAMDHFQKCFAIIRLKKELAAGRVQKDWKAIRVDFVMPPIDNFAFALLGWTGSRQFERDLRRFARHERKMLLDRHALYDKTKKIFLPAKTEEDIFAHLGLEYIPPWQRNA

SEQ ID NO: 585 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVMEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAILTLTGGFRRGKECGHDVDFLITTPEMGKEQLLPKVINLWEKKGLLLYYDLVESTFDKSRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 586 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRGIAPDAILTLTGGFRRGKECGHDVDFLITTPEMGKEQLLPKVIDLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 587 - protein, 362 aa, Artificial Sequence
  Modified TdT Sequence
MENLYFQGTVSQYACQRRTTMENHNQVFTDAFAILAENAEFNESEGPCLAFRRAASLLKSLPHAISSSKDLEGLPCLGDQTKAVIEDILEYGQCSKVQDVLCDDRYQTIKLFTSVFGVGPKTAEKWYRKGFHSLEEVQADKAIHFTKMQKAGFLYYDDITAAVCKAEADAIGQIVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 588 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLQGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPRVINLWEKKGLLLYYDLVESTFDKTRLPCRKFEAMDHFQKCFAIIKLKKELAAGRVQKDWKAIRVDFVMPPVDRFAFALLGWTGSRQFERDLRRFARHERKMLLDRHALYDKTKKIFLPAKTEEDIFAHLGLDYIPPWQRNA

SEQ ID NO: 589 - protein, 362 aa, Artificial Sequence
  Modified TdT Sequence
MENLYFQGTVSQYACQRRTTMENHNQIFTDAFAILAENAEFNENEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRAKECGHDVDFLITTPEMGKEQLLPDVINLLEKKGLLLYYDLVESTFDKTRLPCRKFEAMDHFQKCFAIIKLKKELAAGCVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 590 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQRAGFLYYDDISAAVCKAEADAIGQIVEETVHGIAPDAIVTLTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 591 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRGIAPDAIVTLTGGFRRGKEIGHDVDFLITTPEMGREQLLPRVINLLEKKGLLLYYDLVESTFDKTRLPCRKFEAMDHFQKCFAIIKLKKELAAGRVQKDWKAIRVDFVMPPVDCFAFALLGWTGSRQFERDLRRFARHERKMLLDRHALYDKTKKIFLPAKTEEDIFAHLGLDYIPPWQRNA

SEQ ID NO: 592 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRGIAPDAIVTLTGGFRRGKEIGHDVDFLITTPEMGKEQLLPRLIDLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 593 - protein, 362 aa, Artificial Sequence
  Modified TdT Sequence
MENLYFQGTVSQYACQRRTTMENHNQIFTDAFAILAENAEFNESEVPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVHLIAPDAIVTLTGGFRRGKEIGHDVDFLITTPEMGKEQLLPKVIDLLEKKGLLLYYDLVESTFDKTRLPCRKFEAMDHFQKCWAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 594 - protein, 362 aa, Artificial Sequence
  Modified TdT Sequence
MENLYFQGTVSQYACQRRTTMENHNQIFTDAFAILAERAEFNESEGPCLAFRRAASLLKSLPHAISSSKDLEGLPCLGDQTKAVIEDIFEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 595 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEEILEYGQCSKVQDVLCDDRYKTIKLFTSVFGVGLKTAEKWYRKGFHSLEEVQADRAIQFTKMQKAGFLYYDDISAAVCKAEADAIGQIVEETVRLIAPDAIVTLTGGFRRGKEIGHDVDFLITTPEMGKEQLLPKVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 596 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKQFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKIINLWEKKGLLLYYDLVESTFDKSRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 597 - protein, 362 aa, Artificial Sequence
  Modified TdT Sequence
MENLYFQGTVSQYACQRRTTMENHNQIFTDAFAILAENAEFNESEGPCVAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKIINLWEQKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 598 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRKIAPDAIVTLTGGFRRGKECGHDVDFLITTPEMGKEQLLPDVINLLEKKGLLLYYDLVESTFDKTRLPCRRFEAMDHFQKCFAIIKLKKELAAGRVQKDWKAIRVDFVMPPADNFAFALLGWTGSRQFERDLRRFARHERKMLLDRHALYDKTKKIFLPAKTEEDIFAHLGLEYIPPWQRNA

SEQ ID NO: 599 - protein, 362 aa, Artificial Sequence
  Modified TdT Sequence
MENLYFQGTVSQYACQRRTTMENRNQIFTDAFAILAENAEFNESEGPALAFRRAASLLKSLPHAISSSKDLEGLPCLGDQTKAVIEDILEYGQCSKVQDVLCDDRYKTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEKGKEQLLPDVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 600 - protein, 362 aa, Artificial Sequence
  Modified TdT Sequence
MENLYFQGTVSQYACQRRTTMENHNQIFTDAFAILAENAEFNENEGPALAFRRAASLLKSLPHAISSSKDLEGLPCLGDQTKAVIEEILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEQGKEQLLPDVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLEYIPPWQRNA

SEQ ID NO: 601 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEAGKEQLLPKVIDLLEKKGLLLFYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDRTKKIFLPAKTEEDIFAHLGLDYIPPWQRNA

SEQ ID NO: 602 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISCSKDLEGLPCLGDQTKAVIEDILEYGQCSKVQDVLCDDRYQTIKLFTSVFGVGLKTAEKWYRKGFHSLEEVQANKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDRTKKIFLPAKTEEDIFAHLGLDYIPPWQRNA

SEQ ID NO: 603 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVMEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDRTKKIFLPAKTEEDIFAHLGLDYIPPWQRNA

SEQ ID NO: 604 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQRAGFLYYDDISAAVCKAEADAIGQIVEETVRLIAPDAIVTLTGGFRRGKEIGHDVDFLITTPEMGKEQLLPKVINLLEKKGLLLFYELVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 605 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKSCGHDVDFLITTPEQGKEQLLPDVINLLEKKGLLLYYDLVESTFDKTRLPCRRFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 606 - protein, 362 aa, Artificial Sequence
  Modified TdT Sequence
MENLYFQGTVSQYACQRRTTMENHNQIFTDAFAILAENAEFNESEGPSLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRKIAPDAIVTLTGGFRRGKEIGHDVDFLITTPEMGKEQLLPKVIDLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 607 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEDVQANKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDNFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 608 - protein, 362 aa, Artificial Sequence
  Modified TdT Sequence
MENLYFQGTVSQYACQRRTTMENHNQIFTDAFAILAENAEFNENEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFSKMQKAGFLYYDDISAAVCKAEADAIGRIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 609 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEEILEYGQCSKVQDVLCDDRYQTIKLFTSVFGVGLKTAEKWYRKGFHSLEEVQADKAIQFTKMQKAGFLYYDDISAAVCKAEADAIGQIVEETVRLMAPDAIVTLTGGFRRGKECGHDVDFLITTPEMGKEQLLPDVINLLEKKGLLLYYDLVESTFDKTRLPCRKFEAMDHFQKCFAIIRLKKELAAGRVQKDWKAIRVDFVMPPIDNFAFALLGWTGSRQFERDLRRFARHERKMLLDRHALFDKTKKIFLPAKTEEDIFAHLGLDYIPPWQRNA

SEQ ID NO: 610 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDRTKAVMEDILEYGQCSKVQDVLCDDRYQTIKLFTSVFGVGLKTAEKWYRKGFHSLEEVQAEKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 611 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGCIVEETVRLIAPDAIVTLTGGFRRGKEIGHDVDFLITTPEMGKEQLLPKVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDRTKKIFLPAKTEEDIFAHLGLDYIPPWQRNA

SEQ ID NO: 612 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRMGFHSLEEVQADKAIQFTKMQKAGFLYYDDISAAVCKAEADAIGQIVEETVRLIAPDAIVTLTGGFRRGKEIGHDVDFLITTPEMGREQLLPKVIDLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEEIFAHLGLDYIPPWQRNA

SEQ ID NO: 613 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELADGRVQKDWKAIRVDFVLPPVDNFAFALLGWTGSRQFERDLRRFARHERKMLLDRHALYDKTKKIFLPAKTEEDIFAHLGLDYIPPWQRNA

SEQ ID NO: 614 - protein, 362 aa, Artificial Sequence
  Modified TdT Sequence
MENLYFQGTVSQYACQRRTTMENHNQIFTDAFAILAENAEFNESEGPALAFLRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPKLINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 615 - protein, 362 aa, Artificial Sequence
  Modified TdT Sequence
MENLYFQGTVSQYACQRRTTMENHNQIFTDAFAILAENAEFNESEGPCLAFRRAASVLKSLPHAISSSKDLEGLPCLGDQTKCVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 616 - protein, 362 aa, Artificial Sequence
  Modified TdT Sequence
MENLYFQGTVSQYACQRRTTMENHNQIFTDAFAILAENAEFNESEGPCLAFRRAASVLKSLPHAISSSKDLEGLPCLGDQTKAVIEDILEYGQCSKVQDVLCDDRYQTIKLFTSVFGVGLKTAEKWYRMGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERRMLLDRHALYDKTKKIFLPAKTEEDIFAHLGLDYIPPWQRNA

SEQ ID NO: 617 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKCVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPRIINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 618 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQRAGFLYYDDISAAVCKAEADAIGQIVEETVRLIAPDAIVTLTGGFRRGKEIGHDVDFLITTPEAGKEQLLPKVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 619 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRKIAPDALVTLTGGFRRGKECGHDVDFLITTPEMGKEQLLPDVINLLEKKGLLLYYDLVESTFDKTRLPCRKFEAMDHFQKCFAIIKLKKELAAGRVQKDWKAIRVDFVMPPADNFAFALLGWTGSRQFERDLRRFARHERKMLLDRHALYDKTKKIFLPAKTEEDIFAHLGLDYIPPWQRNA

SEQ ID NO: 620 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDALVTLTGGFRRAKECGHDVDFLITTPEMGKEQLLPDVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLEYIPPWQRNA

SEQ ID NO: 621 - protein, 362 aa, Artificial Sequence
  Modified TdT Sequence
MENLYFQGTVSQYACQRRTTMENHNQIFTDAFAILAENAEFNENEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEAGKEQLLPRVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 622 - protein, 362 aa, Artificial Sequence
  Modified TdT Sequence
MENLYFQGTVSQYACQRRTTMENHNQVFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRMGFHSLEEVQADKAIHFTKMQRAGFLYYDDISAAVCKAEADAIGQIVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 623 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVHLIAPDAIVTLTGGFRRGKSCGHDVDFLITTAEMGKEQLLPDVINLLEKKGLLLYYDLVESTFDKTRLPSRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 624 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDITAAVCKAEADAIGQIVEETVHLIAPDAIVTLTGGFRRGKEIGHDVDFLITTPEMGREQLLPRVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 625 - protein, 362 aa, Artificial Sequence
  Modified TdT Sequence
MENLYFQGTVSQYACQRRTTMENHNQIFTDAFAILAENAEFNENEGPCLAFRRAASLLKSLPHAISSSKDLEGLPCLGDQTKCVIEDILECGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 626 - protein, 362 aa, Artificial Sequence
  Modified TdT Sequence
MENLYFQGTVSQYACQRRTTMENNNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVHLIAPDAIVTLTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVLPPVDNFAFALLGWTGSRQFERDLRRFARHERKMLLDRHALYDKTKKIFLPAKTEEDIFAHLGLDYIPPWQRNA

SEQ ID NO: 627 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEADAIGQIVEETVRLIAPDAIVTLTGGFRRGKECGHDVDFLITTPEMGKEQLLPKVIDLWEKKGLLLYYDLVESTFDKTRLPCRKFEAMDHFQKCFAIIKLKAELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 628 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISRSKDLEGLPCLGDQSKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVIDLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 629 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEEILEYGQCSKVQDVLCDDRYKTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPDVINLLEKKGLLLYYDLIESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 630 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKCVIEDILEYGQCSKVQDVLCDDRYQTIKLFTSVFGVGLKTAEKWYRKGFHSLEEVQAEKAIHFTKMQKAGFLYYDDISAAVCKAEADAIGRIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 631 - protein, 362 aa, Artificial Sequence
  Modified TdT Sequence
MENLYFQGTVSQYACQRRTTMENHNQIFTDAFAILAENAEFNESEGPCLAFLRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKSRLPCRKFEAMDHFQKCFAIIKLKKELADGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 632 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPKVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDRTKKIFLPAKSEEDIFAHLGLDYIPPWQRNA

SEQ ID NO: 633 - protein, 362 aa, Artificial Sequence
  Modified TdT Sequence
MENLYFQGTVSQYACQRRTTMENHNKIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEAGKEQLLPRVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEEIFAHLGLDYIPPWQRNA

SEQ ID NO: 634 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDIFEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPRVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIDPWQRNA

SEQ ID NO: 635 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLITPDAIVTLTGGFRRGKECGHDVDFLITTPEMGKEQLLPRVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 636 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRMGFHSLEEVQADKAIHFTKMQKAGFLYYDDISAAVCKAEADAIGQIVEETVRLIAPDAIVTLTGGFRRGKEIGHDVDFLITTPEMGKEQLLPKVIDLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 637 - protein, 362 aa, Artificial Sequence
  Modified TdT Sequence
MENLYFQGTVSQYACQRRTTMENHNQIFTDAFAILAENAEFNESEGPAVAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEMGKEQLLPKVINLLEKKGLLLYYDLIESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 638 - protein, 362 aa, Artificial Sequence
  Modified TdT Sequence
MENLYFQGTVSQYACQRRTTMENRNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEQGKEQLLPDVINLLEKKGLLLYYDLVESTFDKTRLPCRKFEAMDHFQKCFAIIKLKKERAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 639 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQVVEETVRLIAPDAIVTLTGGFRRGKEIGHDVDFLITTPEMGKEQLLPKVINLLEKKGLLLYYELVESTFDKARLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 640 - protein, 362 aa, Artificial Sequence
  Modified TdT Sequence
MENLYFQGTVSQYACQRRTTMENHNKIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRVINLLEKKGLLLFYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDRTKKIFLPAKTEEDIFAHLGLDYIPPWQRNA

SEQ ID NO: 641 - protein, 362 aa, Artificial Sequence
  Modified TdT Sequence
MENLYFQGTVSQYACQRRTTLENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVHLIAPDAIVTLTGGFRRGKECGHDVDFLITTPEMGKEQLLPDVINLLEKKGLLLYYDLVESTFDKTRLPCRKFEAMDHFQKCFAIIKLKKELAAGCVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 642 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLQGLPCLGDQTKAVIEDIIEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVVNLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 643 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPDVINLLEKKGLLLYYDLIESTFDKTRLPCRKFEAMDHFQKCFAIIKLKKERAAGRVQKDWKAIRVDFVMPPADNFAFALLGWTGSRQFERDLRRFARHERKMLLDRHALYDKTKKIFLPAKTEEDIFAHLGLDYIPPWQRNA

SEQ ID NO: 644 - protein, 362 aa, Artificial Sequence
  Modified TdT Sequence
MENLYFQGTVSQYACQRRTTMENHNQIFTDAFAILAENAEFNENEGPALAFRRAASLLKSLPHAISSSKDLEGLPCLGDQTKAVIEDILEYGQCSKVQDVLCDDRYQTIKLFTSVFGVGLKTAEKWYRMGFHSLEEVQADKAIQFTKMQKAGFLYYDDISAAVCKAEADAIGQIVEETVRLIAPDAIVTLTGGFRRGKEIGHDVDFLITTPEMGKEQLLPKVINLLEKKGLLLFYDLVESTFDKTRLPCRKFEAMDHFQKCFAIIKLKKERAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 645 - protein, 362 aa, Artificial Sequence
  Modified TdT Sequence
MENLYFQGTVSQYACQRRTTMENHNQIFTDAFAILAENAEFNESEGPCLAFLRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELADGRVQKDWKAIRVDFVMPPVDNFAFALLGWTGSRQFERDLRRFARHERKMLLDRHALYDKTKKIFLPAKSEEDIFAHLGLDYIPPWQRNA

SEQ ID NO: 646 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRMGFHSLEEVQADKAIQFTKMQKAGFLYYDDISAAVCKAEADAIGQVVEETVRLIAPDAIVTLTGGFRRGKEIGHDVDFLITTPEAGKEQLLPKVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 647 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQSKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPGMGKEQLLPKVIRLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 648 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPDVINLLEKKGLLLYYDLIESTFDKTRLPCRKFEAMDHFQKCFAIIKLEKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 649 - protein, 362 aa, Artificial Sequence
  Modified TdT Sequence
MENLYFQGTVSQYACQRRTTMENHNQIFTDAFAILAENAEFNESEGPALAFRRAASLLKSLPHTISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDALVTLTGGFRRGKECGHDVDFLITTPEMGKEQLLPDVINLLEKKGLLLYYDLVESTFDKTRLPSRKFEAMDHFQKCFAIIKLKKELAAGRVQKDWKAIRVDFVMPPIDNFAFALLGWTGSRQFERDLRRFARHERKMLLDRHALFDKTKKIFLPAKTEEDIFAHLGLDYIPPWQRNA

SEQ ID NO: 650 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDRSKAVIEDILECGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 651 - protein, 362 aa, Artificial Sequence
  Modified TdT Sequence
MENLYFQGTVSQYACQRRTTMENHNQIFTDAFAILAENAEFNENEGPALAFRRAASLLKSLPHAISSSKDLEGLPCLGDQTKAVIEDILEYGQCSKVQDVLCDDRYQTIKLFTSVFGVGLKTAEKWYRKGFHTLEEVQADKAIQFTKMQKAGFLYYDDISAAVCKAEADAIGQIVEETVRLIAPDAIVTLTGGFRRGKECGHDVDFLITTPEMGKEQLLPKVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 652 - protein, 362 aa, Artificial Sequence; identical to SEQ ID NO: 352
  Modified TdT Sequence

SEQ ID NO: 653 - protein, 362 aa, Artificial Sequence
  Modified TdT Sequence
MENLYFQGTVSQYACQRRTTMENHNQIFTDAFAILAENAEFNENEGPCLAFRRAASLLKSLPHAISSSKDLEGLPCLGDQSKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKNCGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 654 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRAIAPDALVTLTGGFRRGKSCGHDVDFLITTPEMGKEQLLPKVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 655 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGPKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRVINLLEQKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 656 - protein, 362 aa, Artificial Sequence
  Modified TdT Sequence
MENLYFQGTVSQYACQRRTTMENHNQIFTDAFAILAENAEFNENEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVALTGGFRRGKEIGHDVDFLITTPEMGKEQLLPRVINLLEKKGLLLYYDLVESTFDKTRLPCRKFEAMDHFQKCFAIIKLKKELADGRVQKDWKAIRVDFVMPPVDNFAFALLGWTGSRQFERDLRRFARHERKMLLDRHALYDKTKKIFLPAKTEEEIFAHLGLDYIPPWQRNA

SEQ ID NO: 657 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYKTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFIITTPEQGKEQLLPDVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 658 - protein, 362 aa, Artificial Sequence
  Modified TdT Sequence
MENLYFQGTVSQYACQRRTTMENHNQIFTDAFAILAENAEFNESEGPSLAFRRAASLLKSLPHAISSSKDLEGLPCLGDQTKAVIEDILEYGQCSKVQDVLCDDRYKTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEAGKEQLLPKVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 659 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDITAAVCKAEADAIGQIVEETVRLIAPDAIVTLTGGFRRGKEIGHDVDFLITTPEAGKEQLLPRVIDLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 660 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHTLEEVQADKAIQFTKMQKAGFLYYDDISAAVCKAEADAIGQIVEETVRLIAPDAIVTLTGGFRRGKEIGHDVDFLITTPEAGKEQLLPKVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLEYIPPWQRNA

SEQ ID NO: 661 - protein, 362 aa, Artificial Sequence
  Modified TdT Sequence
MENLYFQGTVSQYACQRRTTMENHNQLFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDALVTLTGGFRRGKECGHDVDFLITTPEMGKEQLLPDLINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 662 - protein, 362 aa, Artificial Sequence
  Modified TdT Sequence
MENLYFQGTVSQYACQRRTTMENHNQIFTDAFAILAENAEFNENEGPALAFRRAASLLKSLPHAISSSKDLEGLPCLGDQTKAVIEDILEYGQCSKVQDVLCDDRYQTIKLFTSVFGVGLKTAEKWYRMGFHSLEEVQADKAIQFTKMQKAGFLYYDDISAAVCKAEADAIGQIVEETVRLIAPDAIVTLTGGFRRGKEIGHDVDFLITTPEMGKEQLLPKVINLLEKKGLLLYYDLVESTFDKTRLPCRKFEAMDHFQKCFAIIKLKKELADGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 663 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEMGKEQLLPRVIDLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDRTKKIFLPAKTEEDIFAHLGLDYIPPWQRNA

SEQ ID NO: 664 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPDLINLLEKKGLLLYYHLVESTFDKTRLPCRKFEAMDHFQKCFAIIKLKKELAAGRVQKDWKAIRVDFVMPPIDNFAFALLGWTGSRQFERDLRRFARHERKMLLDRHALFDKTKKIFLPAKTEEDIFAHLGLDYIPPWQRNA

SEQ ID NO: 665 - protein, 362 aa, Artificial Sequence
  Modified TdT Sequence
MENLYFQGTVSQYACQRRTTLENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEKGKEQLLPDVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLEYIPPWQRNA

SEQ ID NO: 666 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADRAIQFTKMQKAGFLYYDDISAAVCKAEADAIGQIVEETVRLIAPDALVTLTGGFRRGKECGHDVDFIITTPEMGKEQLLPDVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 667 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDALVTLTGGFRRGKECGHDVDFLITTPEMGKEQLLPDVINLLEKKGLLLYYDLIESTFDKTRLPCRRFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 668 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVVNLWEKKGLLLYYDLVESTFDKTRLPCRKFEAMDHFQKCFAIIKLKKELAAGRVQKDWKAIRVDFVMPPVDCFAFALLGWTGSRQFERDLRRFARHERKMLLDRHALYDRTKKIFLPAKTEEDIFAHLGLDYIPPWQRNA

SEQ ID NO: 669 - protein, 362 aa, Artificial Sequence
  Modified TdT Sequence
MENLYFQGTVSQYACQRRTTMENHNQIFTDAFAILAENAEFNENEGPCLAFRRAASLLKSLPHAISSSKDLEGLPCLGDQTKAVIEDIFEYGQCSKVQDVLCDDRYQTIKLFTSVFGVGLKTAEKWYRKGFHSLEEVQADKAIHFTKMQKAGFLYYDDISAAVCKAEADAIGQVVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 670 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEEILEYGQCSKVQDVLCDDRYQTIKLFTSVFGVGLKTAEKWYRKGFHSLEEVQADKAIQFTKMQKAGFLYYDDISAAVCKAEADAIGQIVEETVRAIAPDAIVTLTGGFRRGKECGHDVDFIITTPEMGKEQLLPDVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 671 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPKVINLWEKKGLLLYYDLVESTFDKTRLPCRKFEAMDHFQKCFAIIKLKKELADGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 672 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEAGKEQLLPKVINLWEKKGLLLYYDLVESTFDKSRLPCRKFEAMDHFQKCFAIIKLKKELAAGRVQKDWKAIRVDFVMPPVDCFAFALLGWTGSRQFERDLRRFARHERKMLLDRHALYDKTKKIFLPAKTEEDIFAHLGLDYIPPWQRNA

SEQ ID NO: 673 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRKMAPDAIVTLTGGFRRGKECGHDVDFLITTPEMGKEQLLPDVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKRIFLPAKTEEDIFAHLGLDYIPPWQRNA

SEQ ID NO: 674 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPKVINLLEKKGLLLYYDLVESTFDKTRLPCRKFEAMDHFQQCFAIIKLKQELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 675 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRMGFHSLEEVQADKAIHFTKMQKAGFLYYDDISAAVCKAEADAIGQIVEETVRLIAPDAIVTLTGGFRRGKECGHDVDFLITTPEMGKEQLLPKVINLLEKKGLLLYYDLVESTFDKTRLPCRKFEAMDHFQKCFAIIKLKKELAAGRVQKDWKAIRVDFVMPPVDNYAFALLGWTGSRQFERDLRRFARHERKMLLDRHALYDKTKKIFLPAKTEEDIFAHLGLDYIPPWQRNA

SEQ ID NO: 676 - protein, 362 aa, Artificial Sequence
  Modified TdT Sequence
MENLYFQGTVSQYACQRRTTMENHNQIFTDAFAILAENAEFNESEGPCLAFRRAASLLKSLPHAIISSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRGIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDCFAFALLGWTGSRQFERDLRRFARHERKMLLDRHALYDKTKKIFLPAKTEEDIFAHLGLDYIPPWQRNA

SEQ ID NO: 677 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKQFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKRKKIFLPAKTEEDIFAHLGLDYIPPWQRNA

SEQ ID NO: 678 - protein, 362 aa, Artificial Sequence
  Modified TdT Sequence
MENLYFQGTVSQYACQRRTTMENHNQIFTDAFAILAENAEFNENEGPAVAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEMGKEQLLPKVINLLEKKGLLLYYDLVESTFDKTRLPCRKFEAMDHFQKCFAILKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 679 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSLKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEQGKEQLLPDVINLLEKKGLLLYYDLVESTFDKTRLPCRKFEAMDHFQKCFAIIKLNKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 680 - protein, 362 aa, Artificial Sequence
  Modified TdT Sequence
MENLYFQGTVSQYACQRRTTMENHNQIFTDAFAILAENAEFNESEGPCLAFLRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEAGKEQLLPRVINLLEQKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 681 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYKTIKLFTSVFGVGLKTAEKWYRKGFHSLEEVQADKSIHFTKMQKAGFLYYDDISAAVCKAEADAIGQIVEETVRLIAPDAIVTLTGGFRRGKECGHDVDFLITTPEMGKEQLLPDVINLLEKKGLLLYYDLVESTFDKTRLPCRKFEAMDHFQKCFAIIKLKKELAAGRVQKDWKAIRVDFVMPPIDNFAFTLLGWTGSRQFERDLRRFARHERKMLLDRHALYDKTKKIFLPAKTEEDIFAHLGLDYIPPWQRNA

SEQ ID NO: 682 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKQLAAGRVQKDWKAIRVDFVLPPVDCFAFALLGWTGSRQFERDLRRFARHERKMLLDRHALYDKTKKIFLPAKTEEDIFAHLGLDYIPPWQRNA

SEQ ID NO: 683 - protein, 362 aa, Artificial Sequence
  Modified TdT Sequence
MENLYFQGTVSQYACQRRTTMENHNQIFTDAFAILAENAEFNENEGPCLAFRRAASLLKSLPHAISCSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 684 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTAEQGKEQLLPKVINLLEKKGLLLYYDLVESTFDKTRLPCRKFEAMDHFQKCFAIIKLKKELAAGRVQKDWKAIRVDFVMPPADNFAFALLGWTGSRQFERDLRRFARHERKMLLDRHALYDKTKKIFLPAKTEEDIFAHLGLDYIPPWQRNA

SEQ ID NO: 685 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHTLEEVQADKAIQFTKMQKAGFLYYDDISAAVCKAEADAIGQIVEETVRLIAPDAIVTLTGGFRRGKEIGHDVDFLITTPEMGKEQLLPKVINLLEQKGLLLYYELVESTFDKTRLPCRKFEAMDHFQKCWAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 686 - protein, 362 aa, Artificial Sequence
  Modified TdT Sequence
MENLYFQGTVSQYACQRRTTMENHNQIFTDAFAILAENAEFNESEGPCLAFLRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRGIAPDAIVTLTGGFRRGKEIGHDVDFLITTPEMGKEQLLPRVINLLEKKGLLLFYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 687 - protein, 362 aa, Artificial Sequence
  Modified TdT Sequence
MENLYFQGTVSQYACQRRTTTENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFIITTPEMGKEQLLPDVINLLEKKGLLLYYDLVESTFDKTRLPCRKFEAMDHFQKCFAIIKLKKERAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 688 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEAGKEQLLPRVINLWEQKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 689 - protein, 362 aa, Artificial Sequence
  Modified TdT Sequence
MENLYFQGTVSQYACQRRTTMENHNKIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRVIDLLEKKGLLLYYDLVESTFDKTRLPCRKFEAMDHFQKCFAIIKLKKELADGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 690 - protein, 362 aa, Artificial Sequence
  Modified TdT Sequence
MENLYFQGTVSQYACQRRTTMENHNQIFTDAFAILAENAEFRESEGPAVAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEMGKEQLLPKVINLLEKKGLLLYYDLVESTFDKTRLPCRKFEAMDHFQKCFAIIKLKKEQAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 691 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISRSKDLEGLPCLGDQTKAVIEDILEYGQCSKVQDVLCDDRYQTIKLFTSVFGVGLKTAEKWYRKGFHSLEEVQAEKAIHFTKMQKAGFLYYDDISAAVCKAEADAIGQIVEETVRLIAPDAIVTLTGGFRRGKECGHDVDFLITTPEMGKEQLLPKVINLWEQKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 692 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKGVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPKVIDLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 693 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPRVINLLEKKGLLLYYDLVESTFDKTRLPCRKFEAMDHFQKCFAIIKLKKELADGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 694 - protein, 362 aa, Artificial Sequence
  Modified TdT Sequence
MENLYFQGTVSQYACQRRTTMENHNQIFTDAFAILAENAEFNESESPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRVINLLEKKGLLLFYDLVESTFDKTRLPCRKFEAMDHFQKCFAIIKLKQELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 695 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKAQDVLCDDRYQTIKLFTSVFGVGLKTAEKWYRKGFHSLEEVQAEKAIHFSKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 696 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRMGFHSLEEVQADKAIHFTKMQKAGFLYYDDISAAVCKAEADAIGQIVEETVRLIAPDAIVTLTGGFRRGKEIGHDVDFLITTPEMGREQLLPRVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 697 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRMGFHSLEEVQADKAIHFTKMQKAGFLYYDDISAAVCKAEADAIGRIVEETVRGIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 698 - protein, 362 aa, Artificial Sequence
  Modified TdT Sequence
MENLYFQGTVSQYACQRRTTMENHNQLFTDAFAILAENAEFNESEGPALAFRRAASLLKSLPHAISSLKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPDVINLLEKKGLLLYYDLVESTFDKTRLPCRKFEAMDHFQKCFAIIKLKKELAAGCVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 699 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEMGREQLLPKVINLLEKKGLLLYYHLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKRIFLPAKTEEDIFAHLGLDYIPPWQRNA

SEQ ID NO: 700 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYKTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPDVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALFDKTKKIFLPAKTEEDIFAHLGLEYIPPWQRNA

SEQ ID NO: 701 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVMEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGREQLLPKVINLWEKKGLLLYYDLVESTFDKTRLPCRKFEAMDHFQKCFAIIKLKKELAAGRVQKDWKAIRVDFVLPPVDNFAFALLGWTGSRQFERDLRRFARHERKMLLDRHALYDKTKKIFLPAKTEEDIFAHLGLDYIPPWQRNA

SEQ ID NO: 702 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVMPPVDCFAFALLGWTGSRQFERDLRRFARHERKMLLDRHALYDRTKKIFLPAKTEEDIFAHLGLDYIDPWQRNA

SEQ ID NO: 703 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPKVINLLEQKGLLLYYDLVESTFDKTRLPCRKFEAMDHFQKCFAIIKLKKELAAGRVQKDWKAIRVDFVMPPADNFAFALLGWTGSRQFERDLRRFARHERKMLLDRHALYDKTKKIFLPAKTEEEIFAHLGLDYIPPWQRNA

SEQ ID NO: 704 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQRAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDNFQKCFAIIKLKKELAAGRVQKDWKAIRVDFVMPPVDNFAFALLGWTGSRQFERDLRRFARHERKMLLDRHALYDKRKKIFLPAKTEEDIFAHLGLDYIPPWQRNA

SEQ ID NO: 705 - protein, 362 aa, Artificial Sequence
  Modified TdT Sequence
MENLYFQGTVSQYACQRRTTMENHNQIFTDAFAILAENAEFNESEGPCLAFRRAASVLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGKEQLLPKVIRLWEKKGLLLYYDLVESTFDKTRLPCRKFEAMDHFQKCFAIIKLKKELAAGRVQKDWKAIRVDFVMPPVDRFAFALLGWTGSRQFERDLRRFARHERKMLLDRHALYDKTKKIFLPAKTEEDIFAHLGLDYIPPWQRNA

SEQ ID NO: 706 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSLKDLEGLPCLGDQTKAVIEDILEYGQCSKVQDVLCDDRYQTIKLFTSVFGVGLKTAEKWYRMGFHSLEEVQADKAIQFTKMQRAGFLYYDDISAAVCKAEADAIGQIVEETVRLIAPDAIVTLTGGFRRGKEIGHDVDFLITTPEMGKEQLLPKVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 707 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFIITTPEMGKEQLLPKVIDLLEKKGLLLYYDLVESTFDKTRLPCRKFEAMDHFQKCFAIIKLKKERAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 708 - protein, 362 aa, Artificial Sequence
  Modified TdT Sequence
MENLYFQGTVSQYACQRRTTLENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADRAIQFTKMQKAGFLYYDDISAAVCKAEADAIGQIVEETVRLIAPDAIVTLTGGFRRGKECGHDVDFLITTPEQGKEQLLPDVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKRIFLPAKTEEDIFAHLGLDYIPPWQRNA

SEQ ID NO: 709 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGPKTAEKWYRKGFHSLEEVQADKAIHFTKMQKAGFLYYDDISAAVCKAEADAIGCIVEETVRLIAPDAIVTLTGGFRRGKEIGHDVDFLITTPEMGKEQLLPRVINLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIDPWQRNA

SEQ ID NO: 710 - protein, 362 aa, Artificial Sequence
  Modified TdT Sequence
MENLYFQGTVSQYACQRRTTMENHNQIFTDAFAILAENAEFNESEGPCLAFRRAASVLKSLPHAISCSKDLEGLPCLGDQTKAVIEDILEYGQCSKVQDVLCDDRYQTIKLFTSVFGVGLKTAEKWYRKGFHSLEEVQADKAIHFTKMQRAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 711 - protein, 362 aa, Artificial Sequence
  Modified TdT Sequence
MENLYFQGTVSQYACQRRTTMENHNQIFTDAFAILAENAEFNENEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEMGKEQLLPDVIDLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 712 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPDLINLLEKKGLLLYYDLVESTFDKTRLPCRKFEAMDHFQKCFAIIRLKKELAAGRVQKDWKAIRVDFVMPPADNFAFALLGWTGSRQFERDLRRFARHERKMLLDRHALYDKTKKIFLPAKTEEDIFAHLGLDYIPPWQRNA

SEQ ID NO: 713 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKEIGHDVDFLITTPEAGKEQLLPRVINLLEKKGLLLYYDLVESTFDKTRLPCRKFEAMDHFQKCFAIIKLKKELAAGRVQKDWKAIRVDFVLPPVDCFAFALLGWTGSRQFERDLRRFARHERKMLLDRHALYDKTKKIFLPAKTEEDIFAHLGLDYIPPWQRNA

SEQ ID NO: 714 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGCIVEETVHLIAPDAIVTLTGGFRRGKEIGHDVDFLITTPEMGKEQLLPRVINLLEKKGLLLYYDLVESTFDKTRLPCRKFEAMDHFQKCFAIIKLKKELADGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 715 - protein, 362 aa, Artificial Sequence
  Modified TdT Sequence
MENLYFQGTVSQYACQRRTTTENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPKVINLLEKKGLLLYYDLVESTFDKTRLPCRKFEAMDHFQKCFAIIKLEKELAAGRVQKDWKAIRVDFVMPPIDNFAFALLGWTGSRQFERDLRRFARHERKMLLDRHALFDKTKKIFLPAKTEEDIFAHLGLDYIPPWQRNA

SEQ ID NO: 716 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQRAGFLYYDDISAAVCKAEADAIGQIVEETVRLIAPDAIVTLTGGFRRGKEIGHDVDFLITTPEMGKEQLLPKVIDLLEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEEIFAHLGLDYIPPWQRNA

SEQ ID NO: 717 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADRAIQFTKMQKAGFLYYDDISAAVCKAEADAIGQIVEETVRKIAPDAIVTLTGGFRRGKECGHDVDFLITTPEKGKEQLLPDVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 718 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPKVINLLEKKGLLLYYDLIESTFDKTRLPCRKFEAMDHFQKCFAIIKLKKELADGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 719 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVALTGGFRRGKECGHDVDFLITTPEMGKEQLLPRVIDLWEKKGLLLYYDLVESTFDKTRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 720 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGHIVEETVRLIAPDAIVTLTGGFRRGKECGHDVDFLITTPEMGKEQLLPDVINLLEKKGLLLYYDLVESTFDKTRLPCRKFEAMDHFQKCFAIIRLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 721 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKEIGHDVDFLITTPEMGKEQLLPKVINLLEKKGLLLYYDLVESTFDKTRLPCRKFEAMDHFQKCFAIIKLKKELADGRVQKDWKAIRVDFVMPPADNFAFALLGWTGSRQFERDLRRFARHERKMLLDRHALYDKTKRIFLPAKTEEDIFAHLGLDYIPPWQRNA

SEQ ID NO: 722 - protein, 362 aa, Artificial Sequence
  Modified TdT Sequence
MENLYFQGTVSQYACQRRTTMENHNQIFTDAFAILAENAEFNESEGPALAFLRAASLLKSLPHAISSSKDLEGLPCLGDQTKAVIEDILEYGQCSKVQDVLCDDRYQTIKLFTSVFGVGLKTAEKWYRKGFHSLEEVQADKAIQFTKMQKAGFLYYDDISAAVCKAEADAIGCIVEETVRLIAPDAIVTLTGGFRRGKEIGHDVDFLITTPEMGKEQLLPKVINLLEKKGLLLYYDLVESTFDKTRLPCRKFEAMDHFQKCFAIIKLKKELAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 723 - protein, 362 aa, Artificial Sequence
  Modified TdT Sequence
MENLYFQGTVSQYACQRRTTMENHNQIFTDAFAILAENAEFNESEGPCLAFLRAASLLKSLPHAISSSKDLEGLPCLGDQTKAVIEDILEYGQCSKVQDVLCDDRYQTIKLFTSVFGVGLKTAEKWYRKGFHSLEEVQANKAIHFTKMQKAGFLYYDDISAAVCKAEADAIGQIVEETVRLIAPDAIVTLTGGFRRGKECGHDVDFLITTPEMGKEQLLPKVINLWEKKGLLLYYDLVESTFDKTRLPCRKFEAMDHFQKCFAIIKLKAELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 724 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKVQDVLCDDRYQTIKLFTSVFGVGLKTAEKWYRKGFHSLEEVQADKAIHFTKMQRAGFLYYDDISAAVCKAEADAIGQIVEETVRLIAPDAIVTLTGGFRRGKEIGHDVDFLITTPEMGREQLLPRVINLLEKKGLLLYYDLVESTFDKTRLPCRKFEAMDHFQKCFAIIKLKKELADGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 725 - protein, 362 aa, Artificial Sequence
  Modified TdT Sequence
MENLYFQGTVSQYACQRRTTMENHNQIFTDAFAILAENAEFNESEGPALAFRRAASLLKSLPHAISSSKDLEGLPCLGDQTKAVIEEILEYGQCSKVQDVLCDDRYQTIKLFTSVFGVGLKTAEKWYRKGFHSLEEVQADKAIQFTKMQKAGFLYYDDISAAVCKAEADAIGQIVEETVRLIAPDAIVTLTGGFRRGKECGHDVDFLITTPEMGKEQLLPDVMNLLEKKGLLLYYDLVESTFDKTRLPCRKFEAMDHFQKCFAIIKLKKERAAGRVQKDWKAIRVDFVMPPIDNFAFALLGWTGSRQFERDLRRFARHERKMLLDRHALYDKTKKIFLPAKTEEDIFAHLGLDYIPPWQRNA

SEQ ID NO: 726 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDIIEYGQCSKVQDVLCDDRYQTIKLFTSVFGVGLKTAEKWYRKGFHSLEEVQADKAIHFTKMQKAGFLYYDDISAAVCKAEADAIGQIVEETVRLIAPDAIVTLTGGFRRGKECGHDVDFLITTPEMGREQLLPKVINLWEKKGLLLYYDLVESTFDKTRLPCRKFEAMDHFQKCFAIIKLKKELADGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 727 - protein, 362 aa, Artificial Sequence
  Modified TdT Sequence
MENLYFQGTVSQYACQRRTTMENHNQIFTDAFAILAENAEFNESEGPCLAFRRAASLLKSLPHAISSSKDLEGLPCLGDQTKAVIEDILEYGQCSKAQDVLCDDRYQTIKLFTSVFGVGLKTAEKWYRKGFHSLEEVQADKAIHFTKMQKAGFLYYDDISAAVCKAEADAIGRIVEETVRLIAPDAIVTLTGGFRRGKECGHDVDFLITTPEMGKEQLLPKVINLWEKKGLLLYYDLVESTFDKLRLPCRKFEAMDHFQKCFAIIKLKKELAAGRVQKDWKAIRVDFVMPPVDNFAFALLGWTGSRQFERDLRRFARHERKMLLDRHALYDKTKKIFLPAKTEEDIFAHLGLDYIPPWQRNA

SEQ ID NO: 728 - DNA, 1488 bp, Artificial Sequence
  DNA Sequence
atgctgcatattccgattttcccgccgattaagaagcgccagaagctgccggagagcagaaattcctgcaaatatgaagtcaagttctctgaagttgcgattttcctggttgagcgcaagatgggtagcagccgtcgcaagtttctgaccaacctggcgcgtagcaagggctttcgtatcgaagatgttttgagcgatgcggtgacccacgttgtcgccgaggacaacagcgcggacgagctgtggcagtggctccaaaattccagcctgggtgatctgtccaaaattgaagtcctggacatttcatggttcaccgagtgtatgggtgccggtaaacctgtgcaagtcgaggcccgtcactgcctggtcaagagctgtccggtgatcgatcagtaccttgagccatccacggttgaaacggtcagccaatatgcgtgccaacgtcgtacgaccatggagaaccataaccagattttcacggacgcatttgccatcctggcggagaatgctgagtttaacgagagcgagggtccgtgcctggcgtttatgcgtgcagctagcctgctgaaatcgttgccgcacgcaatttctagcagcaaagacctggaaggtctgccgtgcctgggcgaccagacgaaagccgtaatcgaggacatcttagaatacggtcagtgcagcaaagttcaagatgtgttgtgtgatgaccgttaccagaccatcaaactgttcacgagcgtttttggcgtgggcctgaaaactgcagagaagtggtaccgcaagggtttccactctctggaagaagtgcaagcggataatgcgatccatttcacgaaaatgcaaaaagcgggcttcctgtactatgatgacattagcgcagcagtttgtaaggctgaggcccaagcgatcggtcagatcgtcgaagagactgtgcgtctgatcgcaccggatgcgattgtcaccctgacgggcggttttcgccgtggtaaagagtgcggtcacgacgttgactttctgatcaccaccccggaaatgggcaaagaagtgtggctgctgaatcgtctgattaaccgtctgcagaatcagggtattctgttgtattatgacattgttgagagcaccttcgacaaaacccgtctgccgtgtcgcaagttcgaggcaatggaccattttcagaagtgctttgcgatcattaagttgaagaaagaactggcggctggccgtgtgcaaaaagactggaaagcgatccgtgttgatttcgtggctccgccggtcgacaatttcgcctttgcattgctgggttggaccggtagccgtcagttcgagcgtgatctgcgccgctttgcgcgccacgaacgtaagatgctgctggataaccatgcactgtacgataagaccaaaaagattttcctgccggccaaaaccgaagaagatatctttgcgcacctgggcttggactacatcgatccatggcaacgcaacgcgtaatga

SEQ ID NO: 729 - protein, 355 aa, Artificial Sequence
  Modified TdT Sequences
TVSQYACQRRTTMENHNQIFTDAFAILAENAEFNESEGPCLAFMRAASLLKSLPHAISSSKDLEGLPCLGDQTKAVIEDILEYGQCSKVQDVLCDDRYQTIKLFTSVFGVGLKTAEKWYRKGFHSLEEVQADNAIHFTKMQKAGFLYYDDISAAVCKAEAQAIGQIVEETVRLIAPDAIVTLTGGFRRGKECGHDVDFLITTPEMGKEVWLLNRLINRLQNQGILLYYDIVESTFDKTRLPCRKFEAMDHFQKCFAIIKLKKELAAGRVQKDWKAIRVDFVAPPVDNFAFALLGWTGSRQFERDLRRFARHERKMLLDNHALYDKTKKIFLPAKTEEDIFAHLGLDYIDPWQRNA

SEQ ID NO: 730 - protein, 494 aa, Pan paniscus
MLPKRRRARVGSPSGDAASSTPPSTRFPGVAIYLVEPRMGRSRRAFLTRLARSKGFRVLDACSSEATHVVMEETSAEEAVSWQERRMAAAPPGCTPPALLDISWLTESLGAGQPVPVECRHRLEVAGPRKGPLSPAWMPAYVCQRPTPLTHHNTGLSEALETLAEAAGFEGSEGRLLTFCRAASVLKALPSPVTTLSQLQGLPHFGEHSSRVVQELLEHGVCEEVERVQRSERYQTMKLFTQIFGVGVKTADRWYREGLRTLDDLREQPQKLTQQQKAGLQHHQDLSTPVLRSDVDALQQVVEEAVGQALPGATVTLTGGFRRGKLQGHDVDFLITHPKEGQEAGLLPRVMCRLQDQGLILYHQHQHSCWESPTRLAQQSHMDAFERSFCIFRLPQPPGAAVGGSTRPCPSWKAVRVDLVVAPVSQFPFALLGWTGSKLFQRELRRFSRKEKGLWLNSHGLFDPEQKTFFQAASEEDIFRHLGLEYLPPEQRNA

SEQ ID NO: 731 - protein, 463 aa, Myotis brandtii
MNSAPLAEPRLAGAEWSRRVAGLGTGSFPLPSSEVTHVVMEQTSAEEAVRWQESRPAPPPGGTHPALLDISWFTESMAAGQPVPVEGRHCLQVAVSREVLPNPVWMPPYACQRPTPLTHHNTSLSEALEMLAEAAGFAGSEGRLLSFSRAASVLKALPCPVTALSQLQGLPHFGGHSCRVIQELLEHGVCEEVERVQRSERYQSMKLFTRIFGVGVRTADQWYREGLRTLDDVWKQVQRLTQQQKAGLQHYQDLSSPVQRPDAEALRQVVEAAVGWALPRATVTLAGGFRRGKLQGHDVDFLITHPEEGQEVGLLPRVMHYLEQQGLVLYQQHQRSPSGDPARLAPKGHSMDTFEQSFCIFRLPRPPRTAEGGTWSPHPSWKAVRVDLVVAPISQFPFALLGWTGSKHFERELRRFSRKERGLWLNSHGLFDPEQKTFFQAATEEDIFRHLGLAYLPPEQRNA

SEQ ID NO: 732 - protein, 517 aa, Sarcophilus harrisii
MHRIRTTDSDHGKKRQKKMDAISSKLYEIKFHEFVLFILEKKMGATRRTFLMDLARKKGFRVESELSNSVTHIVAENNSGSDVLAWLEAHKLETTAHFELLDVSWLIECMKVGKPVDTKGKYQLVESSIASANPDPNEGMLKIQSPAMNAISPYACQRRTTLNNHNQRFTDAFEILAKNYEFRENHGHCLTFLRATSVLKCLPFAIVSMKDAEGLPWIGDEVKGIMEEIIEDGQSLEVQAVLNDERYQAFKLFTSVFGVGLKTAEKWYRMGFRTLSKIQSDKSLKFTKMQKAGFLYYEDLISCVSKAEADAVSLIVKEAVWTFLPDALITITGGFRRGKEFGHDVDFLITSPGGEKEQVDQLLQKVTNLWEKQGLLLYYDLMESTFEDLKLPSRKVDALDHFQKCFLILKLYCQRGDRSKWEGPEGSNGLQTKNWKAIRVDLVVCPYDRYAYALLGWSGSRQFERDLRRYATHEKKMMLDNHALYDKTKRTFLKAESEEEIFSHLGLEYIEPWERNA

SEQ ID NO: 733 - protein, 518 aa, Monodelphis domestica
MHRIRTIDSDFGKKRQKKMDNHISSMIYEIKFHEFVLFILEKKMGATRRTFLTDLARKKGFRVENELSNSVTHIVAENNSGSDVLAWLKTHKMEKTTQFELLDISWLIECMKVGKPVDTKGKYQLMESRVDSANPDPTAGTLNILPPTTKTISQYACQRRTTINNHNQRFTDAFEILAKNYEFKENDDTCLTFMRAISVLKCLPFEVVSLKDTEGLPWIGDEVKGIMEEIIEDGESLEVQAVLNDERYQSFKLFTSVFGVGLKTADKWYRMGFRTLNKIRSDKTLKLTKMQKAGLCYYEDLIDCVSKAEADAVSLLVQDAVWTFLPDALVTITGGFRRGKEFGHDVDFLITSPGAEKEQEDQLLQKVTNLWKKQGLLLYCDLIESTFEDLKLPSRKIDALDHFQKCFLILKLYHHKEDKRKWEMPTGSNESEAKSWKAIRVDLVVCPYDRYAFALLGWSGSRQFERDLRRYATHEKKMMLDNHALYDKTKKIFLKAKSEEEIFAHLGLEYIQPSERNA

SEQ ID NO: 734 - protein, 530 aa, Mus musculus; identical to SEQ ID NO: 3

SEQ ID NO: 735 - protein, 511 aa, Otolemur garnettii
MDPLHMAHSGPRKKRPRQTAASMVSTPQDIKFRDLVLFILEKKMGTTRRTFLMELARTKGFRVENEFSDSVTHIIAENNSGSDVLEWIQVQKIKAGSQMEVLDVSWLIECMRAGKPVEMTGKHQLVVRGDYSPSPNPAPQKTPPLAVQKISQYACQRRTTLNNCNHIFTDAFEIMAENYEFRENEGYSAAFMRAASVLKSLPFTIISMKDTEGVPCLGDNVKCIIEEIIEEGESSEVKAVLNDERYQSFKLFTSVFGVGLKTSEKWFRMGFRTLSKIRSDKSLRFTRMQQAGFLYYEDLVSCVTRAEAEAVGVLVKEAVRAFLPDAFVTMTGGFRRGKNIGHDVDFLITSPGSTEEEEQQLLHKIMDLWEKKGLLLYCDLVESTFEKLKLPSRKVDALDHFQKCFLIFKLHHQRVVDSEQSNQQEGKTWKAIRVDLVMCPYERRAYALLGWTGSRQFERDLRRYATHERKMILDNHGLWDKTKRIFLKAESEEEIFAHLGLDYIEPWERNA

SEQ ID NO: 736 - protein, 510 aa, Chinchilla lanigera
MDPLQAAHSGPRKKRPRQTGTLMVSSPHDVRFGDLVLFILEKKMGTTRRAFLMELARRKGFRVENELSDSVTHIVAENNSGNDVLEWLQVQNIQASSRLELLDVSWLIECMGAGKPVEMTGKHQLLVRRDYPASPKPGPQKTPSLAVQKISEYACQRRTTLNNCNCIFTNAFEILAENCEFRENESSYVTYMRAASVLKSLPFTIISMKDTEGIPCLGEKVKCIIEEIIEDGESSEVNAVLNDERYQSFKLFTSVFGVGLKTSEKWFRMGFRSLNKIKSDKSLKFTRMQKAGFLYYEDLVSCVTRAEAEAVSMLVKEAVWAFLPGAFISMTGGFRRGKEIGHDVDFLITSPEVTEDEKQQLLHKVISLWEKKGLLLYSDLVESTFEKLKLPSRKVDALDHFQKCFLILKLHHQRVDSDKSPQQGGKTWKAIRVDLVVCPYERRAFALLGWTGSRQFERDLRRYATHERKMMLDNHALYDKTKRIFLKAESEEEIFAHLGLDYIEPWERNA

SEQ ID NO: 737 - protein, 509 aa, Bos taurus; identical to SEQ ID NO: 2

SEQ ID NO: 738 - protein, 510 aa, Sus scrofa
MDPPQTVPSSPRKKRPRQVGASMASPAHNIKFRELVLFILEKKMGTTRRTFLMELARRKGFRVENELSDSVTHIVAENNSGSEVLEWLQAQKIRASSQLTLLDVSWLIESMGAGKPVEMTGKHQLVVRTDCSASPSPGSQNTLPPAVKKISQYACQRRTTLNNCNHIFTDAFEVLAENYEFRENETFCLAFMRAASVLKSLPFTIISMKDTEGIPCLGDKVKCVIEEIIEDGESSEVKAVLNDERYQSFKLFTSVFGVGLKTSERWFRMGFRSLSKIRSDKTLKFTRMQKAGFLYYEDLVSCVTRAEAEAVGVLVKEAVQAFLPDAFVTMTGGFRRGKKMGHDVDFLITSPGSTDDEEQQLLPKVVNLWEREGLLLYCDLVESTLEKSKLPSRNVDALDHFQKCFLILKLHHQRVDSGMSSQQEGKTWKAIRVDLVMCPYELRAFALLGWTGSRQFERDLRRYATHERKMILDNHALYDKTKRIFLKAESEEEIFAHLGLDYLEPWERNA

SEQ ID NO: 739 - protein, 494 aa, Lepisosteus oculatus; identical to SEQ ID NO: 1

SEQ ID NO: 740 - protein, 478 aa, Pundamilia nyererei
MFHTPIVPRARKRSRPAEASAPRRERVKFEDVRLYLVERKMGRSRRSFLTELARSKGFIVEDVLSDVVTHVVSEDSQASSLWAWLKGGPVKNLPVMHVLDIDTLAASPEATTPTPMSTVSQYACQRRTTTKNNNKIFTDAFEVLAESHEFNDMEGPCLAFRRAASVLKSLPWTVQNLRVTEDLPCLGEHSMCVIEEILQHGHSFEVEKILSDERYQILKLFTSVFGVGPKTAEKWYRRGLRSFSDVLAEPDIHLNRMQQSGFLHYGDISRAVSKAEAQALGNIIDEAVRAITPDAILTLTGGFRRGKDFGHDVDFIVTTPQLGKEERLLTSVIDRLKQQGILLYCEYQASTFDESKLPSHRFEAMDHFAKCFLILRLEDSQVEGGLQTAEEDRRGWRAVRVDLVSPPVDRYAFTLLGWSGSRQFERDLRRFARMERRMLLDNHALYDKTKKEFLAATTEKDIFAHLGLEYIEPWQRNA

SEQ ID NO: 741 - protein, 6 aa, Artificial Sequence
  Synthetic
MENHNQ

SEQ ID NO: 742 - protein, 5 aa, Artificial Sequence
  Synthetic
ENHNQ

SEQ ID NO: 743 - protein, 11 aa, Artificial Sequence
  Synthetic
SEGPCLAFMRA

SEQ ID NO: 744 - protein, 4 aa, Artificial Sequence
  Synthetic
FMRA

SEQ ID NO: 745 - protein, 7 aa, Artificial Sequence
  Synthetic
HFTKMQK

SEQ ID NO: 746 - protein, 3 aa, Artificial Sequence
  Synthetic
MQK

SEQ ID NO: 747 - protein, 6 aa, Artificial Sequence
  Synthetic
SAAVCK

SEQ ID NO: 748 - protein, 3 aa, Artificial Sequence
  Synthetic
KEC

SEQ ID NO: 749 - protein, 4 aa, Artificial Sequence
  Synthetic
GKEC

SEQ ID NO: 750 - protein, 5 aa, Artificial Sequence
  Synthetic
DHFQK

SEQ ID NO: 751 - protein, 4 aa, Artificial Sequence
  Synthetic
DHFQ

SEQ ID NO: 752 - protein, 14 aa, Artificial Sequence
  Synthetic
FARHERKMLLDRHA

SEQ ID NO: 753 - protein, 14 aa, Artificial Sequence
  Synthetic
FARHERKMLLDNHA

SEQ ID NO: 754 - protein, 21 aa, Artificial Sequence
  Synthetic
FARHERKMLLDNHALYDKTKK

SEQ ID NO: 755 - protein, 21 aa, Artificial Sequence
  Synthetic
FARHERKMLLDRHALYDKTKK

SEQ ID NO: 756 - protein, 5 aa, Artificial Sequence
  Synthetic
DYIDP

SEQ ID NO: 757 - protein, 4 aa, Artificial Sequence
  Synthetic
YIDP

SEQ ID NO: 758 - protein, 5 aa, Artificial Sequence
  Synthetic
YYDIV

SEQ ID NO: 759 - protein, 4 aa, Artificial Sequence
  Synthetic
TGSR

SEQ ID NO: 760 - protein, 7 aa, Artificial Sequence
  Synthetic
APPVDNF

SEQ ID NO: 761 - protein, 7 aa, Artificial Sequence
  Synthetic
MPPVDNF

SEQ ID NO: 762 - protein, 6 aa, Artificial Sequence
  Synthetic
APPVDN

SEQ ID NO: 763 - protein, 7 aa, Artificial Sequence
  Synthetic
MENHNQI

SEQ ID NO: 764 - protein, 12 aa, Artificial Sequence
  Synthetic
SEGPLCLAFMRA

SEQ ID NO: 765 - protein, 8 aa, Artificial Sequence
  Synthetic
MENLYFQG

SEQ ID NO: 766 - protein, 22 aa, Artificial Sequence
  Synthetic
WLLNRLINRLQNQGILLYYDIV

SEQ ID NO: 767 - protein, 4 aa, Artificial Sequence
  Synthetic
VAIF

SEQ ID NO: 768 - protein, 6 aa, Artificial Sequence
  Synthetic
HAISSS

SEQ ID NO: 769 - protein, 5 aa, Artificial Sequence
  Synthetic
DQTKA

SEQ ID NO: 770 - protein, 5 aa, Artificial Sequence
  Synthetic
KGFHS

SEQ ID NO: 771 - protein, 5 aa, Artificial Sequence
  Synthetic
QADNA

SEQ ID NO: 772 - protein, 4 aa, Artificial Sequence
  Synthetic
EAQA

SEQ ID NO: 773 - protein, 5 aa, Artificial Sequence
  Synthetic
TVRLI

SEQ ID NO: 774 - protein, 6 aa, Artificial Sequence
  Synthetic
TPEMGK

SEQ ID NO: 775 - protein, 4 aa, Artificial Sequence
  Synthetic
LAAG

SEQ ID NO: 776 - protein, 355 aa, Artificial Sequence; identical to SEQ ID NO: 729
  Synthetic

SEQ ID NO: 777 - protein, 21 aa, Artificial Sequence
  Synthetic
WLLNRLINRLQNQGILLYYDI

SEQ ID NO: 778 - protein, 22 aa, Artificial Sequence
  Synthetic
QLLPKVINLWEKKGLLLYYDLV

SEQ ID NO: 779 - protein, 4 aa, Artificial Sequence
  Synthetic
LVLF

SEQ ID NO: 780 - protein, 7 aa, Artificial Sequence
  Synthetic
LNNYNHI

SEQ ID NO: 781 - protein, 11 aa, Artificial Sequence
  Synthetic
NEVSYVTFMRA

SEQ ID NO: 782 - protein, 6 aa, Artificial Sequence
  Synthetic
FTIISM

SEQ ID NO: 783 - protein, 5 aa, Artificial Sequence
  Synthetic
DKVKC

SEQ ID NO: 784 - protein, 5 aa, Artificial Sequence
  Synthetic
MGFRS

SEQ ID NO: 785 - protein, 5 aa, Artificial Sequence
  Synthetic
MSDKT

SEQ ID NO: 786 - protein, 7 aa, Artificial Sequence
  Synthetic
KFTKMQK

SEQ ID NO: 787 - protein, 6 aa, Artificial Sequence
  Synthetic
VSCVTR

SEQ ID NO: 788 - protein, 4 aa, Artificial Sequence
  Synthetic
EAEA

SEQ ID NO: 789 - protein, 6 aa, Artificial Sequence
  Synthetic
AVWAFL

SEQ ID NO: 790 - protein, 4 aa, Artificial Sequence
  Synthetic
GKKI

SEQ ID NO: 791 - protein, 6 aa, Artificial Sequence
  Synthetic
SPGSAE

SEQ ID NO: 792 - protein, 5 aa, Artificial Sequence
  Synthetic
YYDLV

SEQ ID NO: 793 - protein, 7 aa, Artificial Sequence
  Synthetic
MCPYENR

SEQ ID NO: 794 - protein, 21 aa, Artificial Sequence
  Synthetic
YATHERKMMLDNHALYDKTKR

SEQ ID NO: 795 - protein, 5 aa, Artificial Sequence
  Synthetic
DYIEP

SEQ ID NO: 796 - protein, 5 aa, Artificial Sequence
  Synthetic
NNYNH

SEQ ID NO: 797 - protein, 6 aa, Artificial Sequence
  Synthetic
MCPYEN

SEQ ID NO: 798 - protein, 14 aa, Artificial Sequence
  Synthetic
YATHERKMMLDNHA

SEQ ID NO: 799 - protein, 4 aa, Artificial Sequence
  Synthetic
YIEP

SEQ ID NO: 800 - protein, 22 aa, Artificial Sequence
  Synthetic
QLLHKVTDFWKQQGLLLYCDIL

SEQ ID NO: 801 - protein, 255 aa, Artificial Sequence
  Synthetic
MDPLQAVHLGPRKKRPRQLGTPVASTPYDIRFRDLVLFILEKKMGTTRRAFLMELARRKGFRVENELSDSVTHIVAENNSGSDVLEWLQLQNIKASSELELLDISWLIECMGAGKPVEMMGRHQLVVNRNSSPSPVPGSQNVPAPAVKKISQYACQRRTTLNNYNQLFTDALDILAENDELRENEGSCLAFMRASSVLKSLPFPITSMKDTEGIPCLGDKVKSIIEGIIEDGESSEAKAVLNDERYKSFKLFTSV

SEQ ID NO: 802 - protein, 7 aa, Artificial Sequence
  Synthetic
LNNYNQL

SEQ ID NO: 803 - protein, 11 aa, Artificial Sequence
  Synthetic
NEGSCLAFMRA

SEQ ID NO: 804 - protein, 6 aa, Artificial Sequence
  Synthetic
FPITSM

SEQ ID NO: 805 - protein, 5 aa, Artificial Sequence
  Synthetic
DKVKS

SEQ ID NO: 806 - protein, 5 aa, Artificial Sequence
  Synthetic
MGFRT

SEQ ID NO: 807 - protein, 5 aa, Artificial Sequence
  Synthetic
QSDKS

SEQ ID NO: 808 - protein, 7 aa, Artificial Sequence
  Synthetic
RFTQMQK

SEQ ID NO: 809 - protein, 6 aa, Artificial Sequence
  Synthetic
VSCVNR

SEQ ID NO: 810 - protein, 6 aa, Artificial Sequence
  Synthetic
AVVTFL

SEQ ID NO: 811 - protein, 4 aa, Artificial Sequence
  Synthetic
GKMT

SEQ ID NO: 812 - protein, 6 aa, Artificial Sequence
  Synthetic
SPEATE

SEQ ID NO: 813 - protein, 7 aa, Artificial Sequence
  Synthetic
MCPYDRR

SEQ ID NO: 814 - protein, 19 aa, Artificial Sequence
  Synthetic
YATHERKMMLDNHALYDRT

SEQ ID NO: 815 - protein, 6 aa, Artificial Sequence
  Synthetic
LNNYNQ

SEQ ID NO: 816 - protein, 8 aa, Artificial Sequence
  Synthetic
SKIQSDKS

SEQ ID NO: 817 - protein, 6 aa, Artificial Sequence
  Synthetic
MCPYDR

SEQ ID NO: 818 - protein, 5 aa, Artificial Sequence
  Synthetic
NNYNQ

SEQ ID NO: 819 - protein, 20 aa, Artificial Sequence
  Synthetic
ESTFEKLRLPSRKVDALDHF

SEQ ID NO: 820 - protein, 19 aa, Artificial Sequence
  Synthetic
HSCCESPTRLAQQSHMDAF

SEQ ID NO: 821 - protein, 494 aa, Homo sapiens
MLPKRRRARVGSPSGDAASSTPPSTRFPGVAIYLVEPRMGRSRRAFLTGLARSKGFRVLDACSSEATHVVMEETSAEEAVSWQERRMAAAPPGCTPPALLDISWLTESLGAGQPVPVECRHRLEVAGPRKGPLSPAWMPAYACQRPTPLTHHNTGLSEALEILAEAAGFEGSEGRLLTFCRAASVLKALPSPVTTLSQLQGLPHFGEHSSRVVQELLEHGVCEEVERVRRSERYQTMKLFTQIFGVGVKTADRWYREGLRTLDDLREQPQKLTQQQKAGLQHHQDLSTPVLRSDVDALQQVVEEAVGQALPGATVTLTGGFRRGKLQGHDVDFLITHPKEGQEAGLLPRVMCRLQDQGLILYHQHQHSCCESPTRLAQQSHMDAFERSFCIFRLPQPPGAAVGGSTRPCPSWKAVRVDLVVAPVSQFPFALLGWTGSKLFQRELRRFSRKEKGLWLNSHGLFDPEQKTFFQAASEEDIFRHLGLEYLPPEQRNA

SEQ ID NO: 822 - protein, 22 aa, Artificial Sequence
  Synthetic
GLLPRVMCRLQDQGLILYHQHQ

SEQ ID NO: 823 - protein, 4 aa, Artificial Sequence
  Synthetic
VAIY

SEQ ID NO: 824 - protein, 7 aa, Artificial Sequence
  Synthetic
LTHHNTG

SEQ ID NO: 825 - protein, 12 aa, Artificial Sequence
  Synthetic
SEGRLLTFCRAA

SEQ ID NO: 826 - protein, 6 aa, Artificial Sequence
  Synthetic
SPVTTL

SEQ ID NO: 827 - protein, 5 aa, Artificial Sequence
  Synthetic
EHSSR

SEQ ID NO: 828 - protein, 5 aa, Artificial Sequence
  Synthetic
EGLRT

SEQ ID NO: 829 - protein, 4 aa, Artificial Sequence
  Synthetic
REQP

SEQ ID NO: 830 - protein, 8 aa, Artificial Sequence
  Synthetic
KLTQQQKA

SEQ ID NO: 831 - protein, 6 aa, Artificial Sequence
  Synthetic
STPVLR

SEQ ID NO: 832 - protein, 4 aa, Artificial Sequence
  Synthetic
DVDA

SEQ ID NO: 833 - protein, 5 aa, Artificial Sequence
  Synthetic
AVGQA

SEQ ID NO: 834 - protein, 4 aa, Artificial Sequence
  Synthetic
GKLQ

SEQ ID NO: 835 - protein, 6 aa, Artificial Sequence
  Synthetic
HPKEGQ

SEQ ID NO: 836 - protein, 5 aa, Artificial Sequence
  Synthetic
YHQHQ

SEQ ID NO: 837 - protein, 5 aa, Artificial Sequence
  Synthetic
DAFER

SEQ ID NO: 838 - protein, 6 aa, Artificial Sequence
  Synthetic
VAPVSQ

SEQ ID NO: 839 - protein, 21 aa, Artificial Sequence
  Synthetic
FSRKEKGLWLNSHGLFDPEQK

SEQ ID NO: 840 - protein, 8 aa, Artificial Sequence
  Synthetic
ANDEYLPP

SEQ ID NO: 841 - protein, 5 aa, Artificial Sequence
  Synthetic
LDNHA

SEQ ID NO: 842 - protein, 5 aa, Artificial Sequence
  Synthetic
KADKA

SEQ ID NO: 843 - protein, 5 aa, Artificial Sequence
  Synthetic
QADKA

SEQ ID NO: 844 - protein, 5 aa, Artificial Sequence
  Synthetic
KADNA

SEQ ID NO: 845 - protein, 5 aa, Artificial Sequence
  Synthetic
QADNS

SEQ ID NO: 846 - protein, 5 aa, Artificial Sequence
  Synthetic
KADNT

SEQ ID NO: 847 - protein, 5 aa, Artificial Sequence
  Synthetic
QADNT

SEQ ID NO: 848 - protein, 6 aa, Artificial Sequence
  Synthetic
MCPVDN

SEQ ID NO: 849 - protein, 6 aa, Artificial Sequence
  Synthetic
MPPVDN

SEQ ID NO: 850 - protein, 6 aa, Artificial Sequence
  Synthetic
ACPVDR

SEQ ID NO: 851 - protein, 6 aa, Artificial Sequence
  Synthetic
VPPVDN

SEQ ID NO: 852 - protein, 6 aa, Artificial Sequence
  Synthetic
LPPVDR

SEQ ID NO: 853 - protein, 6 aa, Artificial Sequence
  Synthetic
ACPYDN

SEQ ID NO: 854 - protein, 6 aa, Artificial Sequence
  Synthetic
LCPVDN

SEQ ID NO: 855 - protein, 6 aa, Artificial Sequence
  Synthetic
MAPVDN

SEQ ID NO: 856 - protein, 14 aa, Artificial Sequence
  Synthetic
WARHERKMILDNHA

SEQ ID NO: 857 - protein, 14 aa, Artificial Sequence
  Synthetic
FARHERKMILDNHA

SEQ ID NO: 858 - protein, 14 aa, Artificial Sequence
  Synthetic
WARHERKMLLDNHA

SEQ ID NO: 859 - protein, 14 aa, Artificial Sequence
  Synthetic
FARHEKKMLLDNHA

SEQ ID NO: 860 - protein, 4 aa, Artificial Sequence
  Synthetic
FRRA

SEQ ID NO: 861 - protein, 4 aa, Artificial Sequence
  Synthetic
EADA

SEQ ID NO: 862 - protein, 4 aa, Artificial Sequence
  Synthetic
YIPP

The invention claimed is:

1. A modified terminal deoxynucleotidyl transferase (TdT) of a wild type TdT, or a truncated version of said modified TdT that retains TdT activity, wherein the wild type TdT has the amino acid sequence SEQ ID NO 1, and wherein said modified TdT or said truncated version thereof differs from said wild type TdT with amino acid modifications at one or more of the amino acids: V32, A33, I34, F35, A53, V68, V71, E97, I101, M108, G109, A110, Q115, V116, S125, T137, Q143, M152, E153, N154, H155, N156, Q157, I158, I165, N169, N173, S175, E176, G177, P178, C179, L180, A181, F182, M183, R184, A185, L188, H194, A195, I196, S197, S198, S199, K200, E203, G204, D210, Q211, T212, K213, A214, I216, E217, D218, L220, Y222, V228, D230, Q238, T239, L242, L251, K260, G261, F262, H263, S264, L265, E267, Q269, A270, D271, N272, A273, H275, F276, T277, K278, M279, Q280, K281, S291, A292, A293, V294, C295, K296, E298, A299, Q300, A301, Q304, I305, T309, V310, R311, L312, I313, A314, I318, V319, T320, G328, K329, E330, C331, L338, T341, P342, E343, M344, G345, K346, W349, L350, L351, N352, R353, L354, I355, N356, R357, L358, Q359, N360, Q361, G362, I363, L364, L365, Y366, Y367, D368, I369, V370, K376, T377, C381, K383, D388, H389, F390, Q391, K392, F394, I397, K398, K400, K401, E402, L403, A404, A405, G406, R407, D411, A421, P422, P423, V424, D425, N426, F427, A430, R438, F447, A448, R449, H450, E451, R452, K453, M454, L455, L456, D457, N458, H459, A460, L461, Y462, D463, K464, T465, K466, K467, T474, D477, D485, Y486, I487, D488, P489.

2. The modified terminal deoxynucleotidyl transferase (TdT) or the truncated version thereof enzyme according to claim 1, wherein the one or more amino acid modifications are within one or more amino acid regions selected from WLLNRLINRLQNQGILLYYDIV (SEQ ID NO: 766), VAIF (SEQ ID NO: 767), MGA, MENHNQI (SEQ ID NO:

763), SEGPCLAFMRA (SEQ ID NO: 743), HAISSS (SEQ ID NO: 768), DQTKA (SEQ ID NO: 769), KGFHS (SEQ ID NO: 770), QADNA (SEQ ID NO: 771), HFTKMQK (SEQ ID NO: 745), SAAVCK (SEQ ID NO: 747), EAQA (SEQ ID NO: 772), TVRLI (SEQ ID NO: 773), GKEC (SEQ ID NO: 749), TPEMGK (SEQ ID NO: 774), DHFQK (SEQ ID NO: 750), LAAG (SEQ ID NO: 775), APPVDNF (SEQ ID NO: 760), FARHERKMLLDNHALYDKTKK (SEQ ID NO: 754), and DYIDP (SEQ ID NO: 756) of the sequence of SEQ ID NO 1.

3. The modified terminal deoxynucleotidyl transferase (TdT) or the truncated version thereof according to claim 1, wherein the one or more amino acid modifications are within one or more amino acid regions selected from one or more of the amino acid regions WLLNRLINRLQNQGILLYYDI (SEQ ID NO: 777), VAIF (SEQ ID NO: 767), MGA, ENHNQ (SEQ ID NO: 742), FMRA (SEQ ID NO: 744), HAI, TKA, FHS, QADNA (SEQ ID NO: 771), MQK, SAAVCK (SEQ ID NO: 747), EAQA (SEQ ID NO: 772), TVR, KEC, TPEMGK (SEQ ID NO: 774), DHFQ (SEQ ID NO: 751), LAAG (SEQ ID NO: 775), APPVDN (SEQ ID NO: 762), FARHERKMLLDNHA (SEQ ID NO: 753), and YIDP (SEQ ID NO: 757) of the sequence of SEQ ID NO 1.

4. The modified terminal deoxynucleotidyl transferase (TdT) or the truncated version thereof according to claim 1, comprising a variant sequence of SEQ ID NO: 776, wherein the variant sequence differs from SEQ ID NO: 776 by one or more amino acid modifications within one or more of the amino acid regions selected from the group consisting of: WLLNRLINRLQNQGILLYYDIV (SEQ ID NO: 766), MENHNQI (SEQ ID NO: 763), SEGPCLAFMRA (SEQ ID NO: 743), HAISSS (SEQ ID NO: 768), DQTKA (SEQ ID NO: 769), KGFHS (SEQ ID NO: 770), QADNA (SEQ ID NO: 771), HFTKMQK (SEQ ID NO: 745), SAAVCK (SEQ ID NO: 747), EAQA (SEQ ID NO: 772), TVRLI (SEQ ID NO: 773), GKEC (SEQ ID NO: 749), TPEMGK (SEQ ID NO: 774), DHFQK (SEQ ID NO: 750), LAAG (SEQ ID NO: 775), APPVDNF (SEQ ID NO: 760), FARHERKMLL-DNHALYDKTKK (SEQ ID NO: 754), and DYIDP (SEQ ID NO: 756).

5. A modified terminal deoxynucleotidyl transferase (TdT) enzyme according to claim 1 wherein the modification within the amino acid region of SEQ ID NO: 766 is at one or more of the amino acids selected from the group consisting of: the 1$^{st}$, the 4$^{th}$, the 5$^{th}$, the 6$^{th}$, the 9$^{th}$, the 10$^{th}$, the 11$^{th}$, the 12$^{th}$, the 13$^{th}$, the 15$^{th}$, and the 21$^{st}$ residue of SEQ ID NO: 766.

6. A modified terminal deoxynucleotidyl transferase (TdT) enzyme according to claim 5 wherein the modification within the amino acid region WLLNRLINRLQNQGIL-LYYDIV (SEQ ID NO: 766) is to QLLPKVINLWEKKGLLLYYDLV (SEQ ID NO: 778).

7. The modified terminal deoxynucleotidyl transferase (TdT) or the truncated version thereof according to claim 1, wherein the one or more amino acid modifications are within one or more amino acid regions selected from VAIF (SEQ ID NO: 767), MGA, ENHNQ (SEQ ID NO: 742), FMRA (SEQ ID NO: 744), HAI, TKA, FHS, QADNA (SEQ ID NO: 771), MQK, SAAVCK (SEQ ID NO: 747), EAQA (SEQ ID NO: 772), TVR, KEC, TPEMGK (SEQ ID NO: 774), DHFQ (SEQ ID NO: 751), LAAG (SEQ ID NO: 775), APPVDN (SEQ ID NO: 762), FARHERKMLLDNHA (SEQ ID NO: 753), and YIDP (SEQ ID NO: 757).

8. The modified terminal deoxynucleotidyl transferase (TdT) or truncated version thereof according to claim 1, wherein the modification is selected from one or more of the amino acids A53, V68, V71, E97, I101, G109, Q115, V116, S125, T137, Q143, N154, H155, Q157, I158, I165, G177, L180, A181, M183, A195, K200, T212, K213, A214, E217, T239, F262, S264, Q269, N272, A273, K281, S291, K296, Q300, T309, R311, E330, T341, E343, G345, N352, N360, Q361, I363, Y367, H389, L403, G406, D411, A421, P422, V424, N426, R438, F447, R452, L455, and/or D488.

9. The modified terminal deoxynucleotidyl transferase (TdT) or truncated version thereof according to claim 1, wherein the modification is selected from one or more of the amino acid changes A53G, V68I, V71I, E97A, I101V, G109E, G109R, Q115E, V116I, V116S, S125R, T137A, Q143P, M152L, M152T, N154H, H155C, H155N, H155R, Q157K, Q157R, I158V, I158L, I158M, I165V, N169R, N173R, S175N, G177S, G177V, G177D, C179A, C179S, L180V, A181E, M183R, L188V, A195T, A195P, S197I, S197L, S198R, S198C, S199L, K200R, E203Q, G204D, D210E, Q211R, T212S, K213S, A214R, A214C, A214G, I216M, E217Q, D218E, L220I, L220F, L220Y, Y222C, V228A, D230E, Q238K, T239S, L242Q, L251P, K260M, F262L, L265F, S264T, E267D, Q269K, D271N, D271E, N272K, A273S, A273T, H275Q, T277S, K281R, S291N, S291T, K296R, Q300D, Q304R, Q304C, Q304H, I305V, T309A, R311W, R311H, L312G, L312K, L312A, I313M, A314T, I318L, V319L, T320A, G328A, E330N, E330S, C331I, L338I, T341S, P342A, E343G, E343Q, M344A, M344Q, M344K, G345R, K346R, N352Q, K353R, K353D, V354I, V354L, I355V, I355M, N356R, N356D, W358L, N360K, Q361K, G362E, I363L, Y366F, Y367C, D368H, D368E, V370I, K376I, T377S, T377L, T377A, C381S, K383R, H389N, H389A, K392Q, F394W, I397L, K398R, K400E, K400N, K401A, K401Q, E402Q, L403Q, L403R, A405D, G406R, R407C, D411N, A421L, A421M, A421V, P422A, P422C, V424Y, V424I, V424A, N426R, N426C, F427Y, A430T, R438K, F447W, R452K, L455I, K453R, Y462F, K464R, T465R, K467R, T474S, D477E, D485E, I487V, and/or D488P.

10. The modified terminal deoxynucleotidyl transferase (TdT) or the truncated version thereof according to claim 7, wherein the one or more amino acid modifications are within one or more amino acid regions selected from F{M}RA (SEQ ID NO: 744), {Q}AD{NA} (SEQ ID NO: 771), EA{Q}A (SEQ ID NO: 772), <u>A</u>PP<u>V</u>D<u>N</u> {AP}P{V}D{N} (SEQ ID NO: 762), {F}ARHE{R}KM{L}LD{N}HA (SEQ ID NO: 753), and YI{D}P (SEQ ID NO: 757), and wherein the one or more amino acid modification are at the amino acid(s) in brackets.

11. The modified terminal deoxynucleotidyl transferase (TdT) or the truncated version thereof according to claim 10, comprising FRRA (SEQ ID NO: 860), QADKA (SEQ ID NO: 843), EADA (SEQ ID NO: 861), MPPVDN (SEQ ID NO: 849), FARHERKMLLDRHA (SEQ ID NO: 752), or YIPP (SEQ ID NO: 862).

12. The modified terminal deoxynucleotidyl transferase (TdT) or the truncated version thereof according to claim 10, comprising FRRA (SEQ ID NO: 860), QADKA (SEQ ID NO: 843), EADA (SEQ ID NO: 861), MPPVDN (SEQ ID NO: 849), FARHERKMLLDRHA (SEQ ID NO: 752), and YIPP (SEQ ID NO: 862).

13. The modified terminal deoxynucleotidyl transferase (TdT) or truncated version thereof according to claim 1, comprising a sequence selected from SEQ ID NO 4 to SEQ ID NO 173 or a truncated version thereof.

14. The modified terminal deoxynucleotidyl transferase (TdT) or truncated version thereof according to claim 1, comprising a sequence selected from SEQ ID NO 174 to SEQ ID NO 343.

15. The modified terminal deoxynucleotidyl transferase (TdT) or truncated version thereof according to claim 1, comprising a sequence selected from SEQ ID NO 344 to 727.

16. A method of nucleic acid synthesis, comprising:
   adding a nucleoside triphosphate having a 3'-blocking group to an initiator oligonucleotide, in the presence of the modified terminal deoxynucleotidyl transferase or truncated version thereof (TdT) as defined in claim 1;
   removing all reagents from the initiator oligonucleotide;
   cleaving the 3'-blocking group in the presence of a cleaving agent; and
   removing the cleaving agent.

17. The method as defined in claim 16, wherein the 3'-blocked nucleoside triphosphate is blocked by either a 3'-O-azidomethyl, 3'-aminooxy or 3'-O-allyl group.

\* \* \* \* \*